(12) United States Patent
Da Costa Garcia et al.

(10) Patent No.: US 9,134,312 B2
(45) Date of Patent: Sep. 15, 2015

(54) ANTIBACTERIAL PHAGE, PHAGE PEPTIDES AND METHODS OF USE THEREOF

(75) Inventors: Miguel Ângelo Da Costa Garcia, Lisbon (PT); Carlos Jorge Sousa De São José, Lisbon (PT); Clara Isabel Rodrigues Leandro, Lisbon (PT); Filipa Maria Rodrigues Pardal Dias Antunes Marçal Da Silva, Belas (PT); Sara Ferreira Llorente Grancho Lourenço, Mem Martins (PT)

(73) Assignees: Tecnifar—Industria Tecnica Farmaceutica, S.A., Lisbon (PT); Technophage, Investigação E Desenvolvimento Em Biotecnologia, SA, Lisbon (PT)

( * ) Notice: Subject to any disclaimer, the term of this patent is extended or adjusted under 35 U.S.C. 154(b) by 947 days.

(21) Appl. No.: 13/148,009

(22) PCT Filed: Feb. 5, 2010

(86) PCT No.: PCT/PT2010/000003
§ 371 (c)(1),
(2), (4) Date: Oct. 10, 2011

(87) PCT Pub. No.: WO2010/090542
PCT Pub. Date: Aug. 12, 2010

(65) Prior Publication Data
US 2012/0052048 A1    Mar. 1, 2012

Related U.S. Application Data

(60) Provisional application No. 61/150,585, filed on Feb. 6, 2009, provisional application No. 61/218,345, filed on Jun. 18, 2009.

(51) Int. Cl.
*A61K 39/00* (2006.01)
*C07K 14/005* (2006.01)
*C12N 7/00* (2006.01)
*A01N 63/00* (2006.01)
*G01N 33/569* (2006.01)
*A61K 35/76* (2015.01)
*A61K 45/06* (2006.01)
*C12N 9/64* (2006.01)
*A61K 38/00* (2006.01)

(52) U.S. Cl.
CPC .......... *G01N 33/56911* (2013.01); *A61K 35/76* (2013.01); *A61K 45/06* (2013.01); *C07K 14/005* (2013.01); *C12N 7/00* (2013.01); *C12N 9/6489* (2013.01); *A61K 38/00* (2013.01); *C12N 2795/10021* (2013.01); *C12N 2795/10022* (2013.01); *C12N 2795/10032* (2013.01); *C12N 2795/14021* (2013.01); *C12N 2795/14022* (2013.01); *C12N 2795/14032* (2013.01)

(58) Field of Classification Search
CPC . A61K 35/76; A61K 2300/00; A61K 31/424; A61K 31/43; A61K 31/7036; A61K 38/51; A61K 45/06; A61K 31/465; A61K 47/48261; A61K 47/4833; C12N 2795/00032; C12N 2795/00031; C12N 7/00; C12N 2795/00051
USPC ............ 424/184.1, 93.6, 260.1, 170.1, 93.47, 424/278.1, 195.11, 78.06; 435/235.1, 435/320.1, 239, 259; 530/350, 402
See application file for complete search history.

(56) References Cited

FOREIGN PATENT DOCUMENTS

| WO | WO 00/69269 | 11/2000 |
|---|---|---|
| WO | WO 2004/052274 | 6/2004 |
| WO | WO 2010/041970 | 4/2010 |

OTHER PUBLICATIONS

Horgan et al., "Phage Lysin LysK Can be Truncated to its CHAP Domain and Retain Lytic Activity Against Live Antibiotic-Resistant Staphlococci," Applied and Environmental Microbiology, 75(3), pp. 872-874, Feb. 1, 2009.
Altschul et al., "Gapped BLAST and PSI-BLAST: A New Generation of Protein Database Search Programs," Nucleic Acids Res. 25(17): 3389-3402, 1997.
Basic Local Alignment Search Tool, BLAST®, NCBI Blast: Nucleotide Sequence (72177 letters) retrieved from http://blast.ncbi.nlm.nih.gov/Blast.cgi, Aug. 26, 2014, 7 pages.
Cello et al., "Chemical Synthesis Of Poliovirus Cdna-Generation Of Infectious Virus In The Absence Of Natural Template," Science 297(5583): 1016-1018, 2002.
Coleman et al., "Virus Attenuation By Genome-Scale Changes In Codon Pair Bias," Science 320:1784-1787, 2008.
Gibson et al., "Complete Chemical Synthesis, Assembly, And Cloning Of A *Mycoplasma genitalium*," Science 319: 1215-1220, 2008.
Gibson et al., "Creation of a Bacterial Cell Controlled by a Chemically Synthesized Genome," Science, 329:52-56, 2010.
König et al., "Synthetic Genomics And Synthetic Biologssy Applications Between Hopes And Concerns," Current Genomics 14: 11-24, 2013.
Liu et al., "Whole-genome Synthesis And Characterization Of Viable S13-Like Bacteriophages," PLoS One, 7(7): 1-7, 2012.

(Continued)

Primary Examiner — Padma V Baskar
(74) Attorney, Agent, or Firm — Margaret B. Brivanlou; Nicole Fortuné; King & Spalding LLP

(57) ABSTRACT

The present invention is directed to the field of phage therapy for the treatment and control of bacterial infections. In particular, the present invention is directed to the novel bacteriophages F1245/05, F168/08, F170/08, F770/05, F197/08, F86/06, F87s/06 and F91a/06, isolated polypeptides thereof, compositions comprising one or more of the novel bacteriophages and/or isolated polypeptides and methods for the treatment and prevention of bacterial infection, either alone or in combination with other antibacterial therapies, e.g., antibiotics or other phage therapies.

16 Claims, 228 Drawing Sheets

(56) References Cited

OTHER PUBLICATIONS

Figure 1:
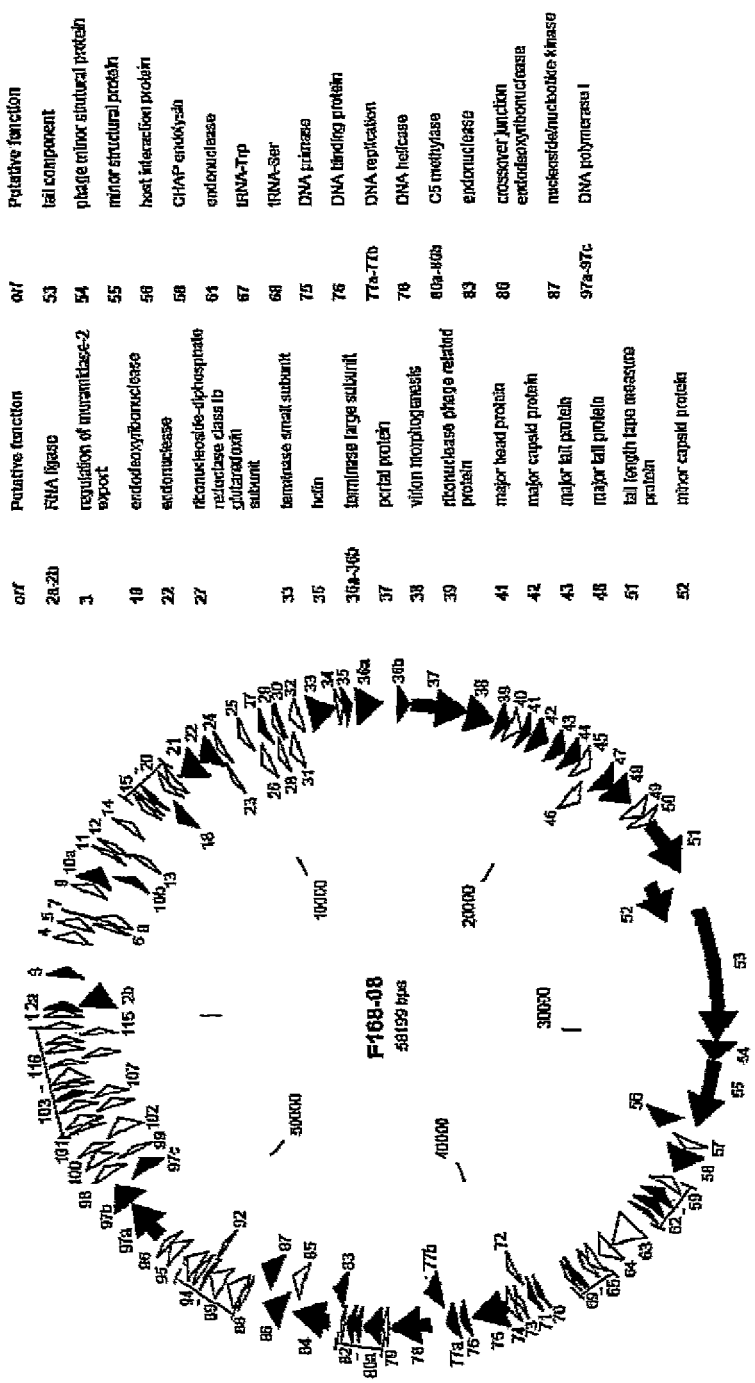

Mueller et al., "Reduction Of The Rate Of Poliovirus Protein Synthesis Through Large-Scale Codon Deoptimization Causes Attenuation Of Viral Virulence By Lowering Specific Infectivity," J Virol 80:9687-9696, 2006.

Mueller et al., "Putting Synthesis into Biology—A Viral View of Genetic Engineering Through de novo Gene and Genome Synthesis," Chem Biol., 16(3):337-347, 2009.

Mueller et al, "Live Attenuated Influenza Virus Vaccines By Computer-Aided Rational Design," Nat Biotechnol, 28: 723-726, 2010.

Smith et al., "Generating a Synthetic Genome By Whole Genome Assembly: φx174 Bacteriophage From Synthetic Oligonucleotides," Proc. Natl. Acad. Sci. USA 100(26): 15440-15445, 2003.

Takehisa et al., "Generation of Infectious Molecular Clones Of Simian Immunodeficiency Virus From Fecal Consensus Sequences Of Wild Chimpanzees," J. Virol. 81(14), 7463-7475, 2007.

Tumpey et al., "Characterization of the Reconstructed 1918 Spanish Influenza Pandemic Virus," Science 310, 77-80, 2005.

Wimmer et al., "Synthetic Viruses: a New Opportunity to Understand and Prevent Viral Disease," Nature Biotechnology, 27(12):1163-1172, 2009.

Yang et al., "Chemical Synthesis of Bacteriophage G4," PLoS One 6(11):1-6, 2011.

| orf | Start position | Stop position | Product aminoacidic sequence | Size (aa) | Homologous/similar proteins | | | Conserved Domains | | | |
|---|---|---|---|---|---|---|---|---|---|---|---|
| | | | | | Name[organism] | Acc No | E value and identity | Predicted function | Name | Acc No | E value |
| 1 | <1 | 207 | WTSFFHNIVGYDEPLSKEVLTAY HLKEITDLNELPEHHKKVFETLS AIEYSTVEGALKTFKTNYVEGI (SEQ ID NO: 8) | 68 | No significant similarity found. | | | | | | |
| 2a | 209 | 481 | MEFLKYPSLVNHYAIGKSKRLVN RFDNILWYASEKIHGANASYALS ATGEEYFAKRSGIISKDDKGFSM LPECVTSDIREGTKKAFRILS (SEQ ID NO: 9) | 90 | RnlB 2nd RNA ligase [Enterobacteria phage RB43] | YP_2392225.1 | 0.010 (30/72) | | | | |
| 2b | 318 | 1094 | MEPTLLMPYQQLGKSISQSVVE LFLKTINNFQCFQNVLPQTFEKV PKKLFEYYPKAESIHVFGEFFGK GVQVMDYDLVKEGKKAFRVFDV IAKYDDGSMAVCGINTWKHLFE QDSIVPYYTLGKTLKEFLETPPS EESALGGYSEGVVLKPLQGYPI NSTQDFLGVKYTEKYLEVRHK PSEQRKKPPKLNNEQVEALNEL GKYITKQRVLNVCSHGDFELIQN NIGKIMLAVKQDAANEFIKEVGS SFTEKRACRSL (SEQ ID NO: 10) | 258 | Hypothetical protein KAOT1_13772 [Kordia algicida OT-1] | ZP_0216035 7.1 | 6e-05 (66/245) | RNA ligase | RNA_ligase | pfam09414 | 1e-06 |
| | | | | | RnlB RNA ligase 2 [Enterobacteria phage RB69] | NP_861881.1 | 0.004 (61/229) | | | | |
| 3 | 1220 | 1525 | MDFNTLIEQVQEWSANKGLDKA APEKQFLKVIEEVGEVAAAMAR NDREELVDGLGDTFVTLIILCQQ LGVVPHEALDTAYGVISKRTGK MVDGVFVKSEDL (SEQ ID NO: 11) | 101 | ArpR [Enterococcus hirae] | CAA90708.1 | 4e-22 (55/99) | regulation of muramidase-2 export | HisI, phosphoribo syl-ATP pyrophosph o-hydrolase | COG0140 | 7e-04 |
| | | | | | gp45 [Listeria phage P35] | YP_0014688 29.1 | 2e-20 (46/92) | | | | |
| 4 | 2295 | 2618 | MMKLIELDNGRKQVFYNNVLMQ YERRGSDVYGNPLYRVYPINFS FKRLKSVYRNYEKGGWEESYYL IQSYNILADMQNIASEVNAKNTF PEFDQTLLKDYREVSAYY (SEQ ID NO: 12) | 107 | No significant similarity found. | | | | No putative conserved domains have been detected | | |

FIG. 2A

| | | | | | |
|---|---|---|---|---|---|
| 5 | 2719 | 2970 | MALTMFEKESLQKENARLKREL ATLKASQKLGGGLNEKELQKAL NSCQRIFKTLNRGKRSLVLSKSA MVASVEYSGSGRSKNL (SEQ ID NO: 13) | 83 | No significant similarity found. | No putative conserved domains have been detected |
| 6 | 2948 | 3106 | VVAQKTYKDCSKTAIREAEKSA WEIMSLENDFRNIHHFLKHGTM KAEDKDNA (SEQ ID NO: 14) | 52 | No significant similarity found. | |
| 7 | 3099 | 3167 | MLNIIVTVISTAAVFKGARNGE (SEQ ID NO: 15) | 22 | No significant similarity found. | No putative conserved domains have been detected |
| 8 | 3157 | 3450 | MVNKKLSDRLTKSIKFSRKKAKK RFIIARVTEEQAYTLRLLKAISKE DEAVCKATNKALLEYGYEEAGG HSYEKAREKFSSLPDVKKVVHTN RRTRKR (SEQ ID NO: 16) | 97 | No significant similarity found. | No putative conserved domains have been detected |
| 9 | 3829 | 4062 | MTKNHYKLYVDMKEGTHDYVSA TVYSMFDEKVLWLPDIKKPENV ADYTDEVMKNGLYSYYEKLAISEL NDYNATFSHL (SEQ ID NO: 17) | 77 | No significant similarity found. | No putative conserved domains have been detected |
| 10a | 4153 | 4611 | MTEFANMKNKEEVLELLNDWFGV SDYVTVMAELEKMKQVTFTGST DIPLLGGNNDLIGLPQFFKGNEV EPEFPTYEELLEELLEKDTWNLEA EDNTYNYSGFLERDMDFKTIHA ENSDTTIAFFAIHTGGRHKSGLL KSNPIYFLKLTTIFKSS (SEQ ID NO: 18) | 153 | Hypothetical protein EFP_gp144 [Enterococcus phage phiEF24C] | YP_0015042 53.1 | 3e-56 (116/142) | No putative conserved domains have been detected |
| 10b | | | | | | 2e-34 (73/92) |
| 11 | 4572 | 4850 | LFFETYYDFQEFLQNYFYGQGY YAFKHDNKEYTISLDISATSEYV RIYISDENNEELQQSYEQETFMD LDREGVEAYLKDEGIEFTDLKHA L (SEQ ID NO: 19) | 92 | No significant similarity found. | No putative conserved domains have been detected |
| 12 | 5060 | 5206 | MENNKAYERLLKEVELLQNDLM DIEDYSEEVYQAFQKMDELEYIQ AS (SEQ ID NO: 20) | 48 | No significant similarity found. | |
| | 5297 | 5455 | MTKQFKNIIATLTILVIALAAASGI ATIKAVENANDKAILAERVEALEK | 52 | No significant similarity found. | |

FIG. 2B

| | | TFR (SEQ ID NO: 21) | | | | | |
|---|---|---|---|---|---|---|---|
| 13 | 5400 | MIKLSLPNVWKLWKKLSDKQEY DIAVKSNVIGAYLINHEEEAQKEY TEAYKAHKPTLLKKLP (SEQ ID NO: 22) | 62 | No significant similarity found. | | | No putative conserved domains have been detected |
| 14 | 6024 | VRGFSEGYLKGVSGRNLKANLE RQVESFVVDLFFIKGNEKPLRNA VAAGLWERWLERLSDSFQID (SEQ ID NO: 23) | 65 | No significant similarity found. | | | |
| 15 | 6689 | MVPNPSYNLINACVNTPLERGK ASRAADKRRPLYLWNLFLKGSK EEPSGKVALKLSDYY (SEQ ID NO: 24) | 59 | No significant similarity found. | | | |
| 16 | 7021 | LTWPLFLWYTIRNDKKGVLKAM LERIK3MLRKIRLANGLATA (SEQ ID NO: 25) | 42 | No significant similarity found. | | | |
| 17 | 7232 | MVAGIQKISLSKGKPVKGVNIKT GEEITFQTVSEVISYGFDKSHVA SCARGESKTHKGFIWKYV (SEQ ID NO: 26) | 65 | Hypothetical protein [Sbx2-converting phage 86] | YP_794120.1 | 1e-04 (19/51) | No putative conserved domains have been detected |
| 18 | 7530 | MVEWRDIEGYEGLYMVSDQGDI FNCSRNSLMKLRKDRKGYLLVG LTKKGNQKTYRVHRIVANAFINNI FKKPQINHLNEVKHDNRVDNLE WVTNKENSNYGSRNTKNKFKQ RKACKRSKY (SEQ ID NO: 27) | 120 | putative endodeoxyribonucle ase [Lactobacillus phage phiAT3] | YP_025078.1 | 3e-18 (49/111) | endodeoxyribo -nuclease NUMOD4 motif | pfam07463 | 2e-07 |
| 19 | 7810 | MNWKAFRLVSLYYLLALVIAFGLI VVITLVFGASVTIAIGRILGNLIILK VIWDMLHKEYEEAKEDLEK (SEQ ID NO: 28) | 69 | No significant similarity found. | | | No putative conserved domains have been detected |
| 20 | 8042 | LSEKLTKRIILAAVIIAYLITVGIIFG ILMLVSLITGWEQLFFYLGVLFLI DLLMETTKYAFIRYNKDKHKTLE EL (SEQ ID NO: 29) | 76 | No significant similarity found. | | | No putative conserved domains have been detected |

FIG. 2C

| | | | | | | | |
|---|---|---|---|---|---|---|---|
| 21 | 8857 | MLFKDENKLIKELKQEIELLTGR KAVYQLALDRLEMANEELQKEV DFLKIREAGFEERLKVASEKEVE AIEMANESAEESLLRQEAYDRL GKKFEEVCQKLTVEEEQNKRW EQEMGRLQEEYNGLIKREYREL QKAIPSKPQLTATIKVDTKEIQEM LDNALQEIKEGYSPRLQEEPEYT YVWIKSEGSSEKHFVSDSPQQLL RKANVFYMPYKAGILTLSESLIE MVTRKKA (SEQ ID NO: 30) | 232 | hypothetical protein [Trichomonas vaginalis G3] | XP_0013256 48.1 | 0.020 (38/120) | No putative conserved domains have been detected |
| 22 | 9436 | LEGEWKVVNGFSNYSITKTGKV VNNLTGKILKPFINDRGYAEIGLG DGNIKRLHRVLLSTYNPIEGWEE LTVNHMDGNKLNNNLDNLEWLT HEDNLKHYYDNNKIRILVFDDAT GEVLEEVTRMEKASTKYGVPKG VIQELCDLYHEGIYAHENGYGFC RMEDFGLDG (SEQ ID NO: 31) | 167 | putative endonuclease [Staphylococcus phage K] | YP_024518.1 | 2e-13 (40/94) | endonuclease | pfam07463 0.009 NUMOD4 motif |
| 23 | 9539 | VLKNKVYAGHVWSYTGREFEK GSPLASKKPIKKVFGG (SEQ ID NO: 32) | 37 | No significant similarity found. | | | |
| 24 | 9693 | MLIIEEDLGGFLVKLIKEVKSVDV ETGLETVYRSAYAASKDLGKYS TSVRNAGAKK (SEQ ID NO: 33) | 55 | No significant similarity found. | | | |
| 25 | 10452 | MKLIDATVVLNYIEKTKNELNTTS PANNSKFGKGWDAGFIRGIESIK GLVKDIIIEDEIPLANPSDMIPKK (SEQ ID NO: 34) | 71 | No significant similarity found. | | | No putative conserved domains have been detected |
| 26 | 10772 | LEYPEDDYDEGYQDAVETCMD EIKAALSVAKEEDSPEPIKLAVD GNIVAESFTGSSVTPINTLPNNY TKDVLEALLEASEDFYDASEIQA LLKGAIQAIPKGKGVIL (SEQ ID NO: 35) | 107 | No significant similarity found. | | | No putative conserved domains have been detected |

FIG. 2D

| | | | | | | | |
|---|---|---|---|---|---|---|---|
| 27 | 11087 | MGMNRIKVYTKDACAAGKMTKR VLTEAGVSFDEVFVDVRNDTET VEMLRLVGFRSFPVVMLDEDFD TAISGFHPPRLKVFIETVKEEA (SEQ ID NO: 36) | 88 | ribonucleoside-diphosphate reductase class Ib glutaredoxin subunit [Pediococcus pentosaceus ATCC 25745] | YP_804960.1 | 1e-9 (33/76) | ribonucleoside-diphosphate reductase class Ib glutaredoxin subunit | NrdH | cd02976 | 3e-12 |
| 28 | 11287 | VLYGKKEDLNEEIYSLEREIEDLE GQVYDLENELGSSEETVEELTE EVDTLSERVEELEEIIESMEEWE (SEQ ID NO: 37) | 69 | No significant similarity found. | | | | No putative conserved domains have been detected |
| 29 | 11465 | MSKLPFEKELKEACSKPTLTQR ETALIELVGKLQNALVDSNWDKL IAEQELEYAEERLTSVVWEKRRL ERGDL (SEQ ID NO: 38) | 73 | No significant similarity found. | | | | No putative conserved domains have been detected |
| 30 | 11520 | MQEITVEEFKQEEIGEF (SEQ ID NO: 39) | 17 | No significant similarity found. | | | | No putative conserved domains have been detected |
| 31 | 11795 | MEGIELDNYYNFLEIGYLEGDQA NVETTVYNLTGMLSAKYSDVTE SEFEAAVEEVTEAIDNLTNSLEV LSELPFTEAKQYLAKEDKKWEDN V (SEQ ID NO: 40) | 91 | No significant similarity found. | | | | No putative conserved domains have been detected |
| 32 | 12106 | MRAIKMYSIKSYQQYLEKLGTVR KAAADFELNNSFSKKAHELIANQ YAEDIEKLSQKVQEYHELIENIVS DEAEEDEKQLMEYLGTIRKQQKI TEELESGGKE (SEQ ID NO: 41) | 103 | No significant similarity found. | | | | No putative conserved domains have been detected |
| 33 | 12390 | MVRIGNRELEERQRKYLTTSKE PDEYEGVDLTTLKPKMKRFARH YMQTMNIAESCRSVGYNESSGY RVLKREDVKAYLQWLVSENADA AIMSPTQVLEELTNIALRNSSDY TVTVKGDVVEKPIDTSVQLSALN SLAKFHDLLAPDVKVEQSLNIVV DIADDVPNEAEEVEEEEFVEGD FTEVEEEDSDVSYDFLSGFLRK EIPMIPEESNLEVIVNDLIKDVNT HANQIASIQSDLNRMTTDISSVR | 255 | bacteriophage terminase small subunit [Staphylococcus aureus] | AAP55238.1 | 1e-07 (42/168) | terminase small subunit | Terminase_2 | pfam03592 | 2e-10 |

FIG. 2E

| | | | | | | |
|---|---|---|---|---|---|---|
| 34 | 13204 | DLLIKKH (SEQ ID NO: 42) | | No significant similarity found. | | |
| 35 | 13380 | MLKLLTEERRRQTESYLADEAS DRKNKEFSQKQMWAVATALVT GVGSALVTIWKLIMS (SEQ ID NO: 43) | 58 | | | No putative conserved domains have been detected |
| | 13647 | MDVVISIAVVLGGVTTGLVNLVK SMDVVSPKYLPLVSLAIGMVFGL AMSPLLGHTLYVGAISGLVAGLS AMGIFYELTKTPAE (SEQ ID NO: 44) | 82 | hypothetical protein BL01378 [Bacillus licheniformis ATCC 14580] | YP_091408.1 | 0.001 (30/79) | |
| | | | | holin [Bacteriophage PL-1] | BAA96748.1 | 0.15 (23/81) | holin | No putative conserved domains have been detected |
| 36a | 13753 | MKPIYHTCTTSLKDNIEQVVYFYG GAGSGKSKFVVQNAILKGLSER RKFLVLRKVDNTIRDSIIFQEFLVC LEEWNLLDFCEVKASYMTIKLPN KTEYIFKGLEDPERIKSIIQGLTDII MEEATEFTREDYDQLQTRLRHP TARHCQVFVMYNPASKDNWVY QYFHNPATKRPKGSKVICTTYK DNRFLPKAYLDHLQDLKNTNPV YYEIYALGKFASLGKRIYTNWKID SEFKPNQLVKQGYEPRFGLDFG LSM (SEQ ID NO: 45) | 253 | phage terminase, large subunit, pbsx family [Clostridium perfringensC str. JGS1495] | ZP_0286535 7.1 | 9e-55 (118/224) | terminase large subunit | Terminase_ 3 | pfam04466 | 1e-34 |
| | | | | terminase large subunit [Lactobacillus prophage Lj928] | AAK27930.1 | 1e-53 (108/235) | | | |
| 36b | 14514 | MIAPEIFDVIKRKKLTNQLIYADS ANLETIEQIKRLGARKIKFPVKKGR NTVLHGIQYLQGYTIYVHPRCVH TIKELENYEWKPAKGSDDYENK PKQNGFDHCMDALRYAVNDLIP RNRIRTINKSVLGL (SEQ ID NO: 46) | 129 | PBSX family phage terminase large subunit [Clostridium noyviNT] | YP_879274.1 | 1e-22 (49/106) | | Terminase_ 3 | pfam04466 | 5e-06 |
| | 14906 | | | ORF009 [Staphylococcus phage 53] | YP_239642.1 | 6e-19 (47/121) | | | |
| | 15295 | | | phage terminase, large subunit, pbsx family [Clostridium perfringensC str. JGS1495] | ZP_0286535 7.1 | 3e-17 (47/117) | | | |

FIG. 2F

| | | | | | | | |
|---|---|---|---|---|---|---|---|
| 37 | 15354 | 16889 | MAIPNGQINAGDIITTNIRRKHFIR RNYDIRELVTLAEMHSRSSSAY GVLYDYYKGNHIAIQSRTFDDTN KPNSKVHNFPKLLVDTSTAYLA GEPITESGDEKTIKAMQPVMKE NYVTDVNSEEIKLSGIFGHCFEIH WIDRNNKHRFKAVSPMNCLIAY SADLDEEPLAAYYNTVISDITGH VIRTYEIYTEDKILKFSTDDERDV YKEIPEVLDIRGYEEHPNLLKKFP VLEIIANEERLGDFEAGLSLIDAY NLAVSDSVNDIAYWNDAYLWLQ GFDLSADSDSISNMKNDRVIVTD DTGNVKFTKDVNDKHIENIKNR AKLDIFSLSQTPDLVSKDFTAAS GQALKAATQPLENKSAVKESKF RKVLAKRYELICSYLELMSKEKD LKPNEVTPVFVRNLPQSYAELA DMAVKLRDMLPDETIINQFPWT DARLEVEKADEQRQKRADIALQ NFKQTSAVQGASTAAANKLDKN PANTSTITTDPVAAHEQEKAIQ KKPKTD (SEQ ID NO: 47) | terminase large subunit [Lactobacillus prophage Lj928] | AAK27930.1 | 2e-17 (44/112) | |
| | | | | hypothetical protein ANACOL_00534 [Anaerotruncus colihominis DSM 17241] | ZP_02441264.1 | 6e-49 (161/473) | |
| | | 511 | | portal protein [Streptococcus phage 10270.2] | YP_598434.1 | 6e-38 (118/423) | portal protein |
| 38 | 16901 | 17856 | MARKKDKEKRQQEIEDALVALM TAQNHKYHRFTDRFTVLLDGFV NELIVNILADPKLDAFAILQVSQYE AIRKLQAALIDYQEEFREMLLES MSDTLLEETLGQLFPNKAIPSATD NAYIEQVIAEAYDYFEEIFQLLLV EIEAIAVGTIPSTEDIVTTIQKLRD RLSYTLRRHEAQMSAVINLAVIE ASKQYEIELVMKWCIRPELTESGT CADGRELAEGGIGNEGLYTLAT MPLLPRHPHCVCILIPYVL (SEQ ID NO: 48) | 251 | Phage Mu protein F like protein [Lactobacillus casei ATCC 334] | YP_3071132.1 | 3e-06 (33/135) | virion morphogenesis |
| | | | | | | | Phage protein Gp6 | pfam05133 | 1e-49 |
| | | | | | | | No putative conserved domains have been detected |

FIG. 2G

| | | | | | | | |
|---|---|---|---|---|---|---|---|
| 39 | 17767 | 18102 | MNPEEQGQGQQVDLTPEVIVGA IESNPELAQAIQPHVLTKDAVSS FLKTDEGLGVVAPMIDQSVSKGI NAWKEKNLENIVQERLAELNPA ETPEQKQLKQMQAQMAAIQKR (SEQ ID NO: 49) | 111 | putative ribonuclease phage related protein [Bacillus licheniformis ATCC 14580] | YP_078653.1 | 2e-08 (26/73) | ribonuclease | No putative conserved domains have been detected |
| 40 | 18107 | 18436 | MLEMRGVAQEALAKAGLPASLA GYVLSDNPEAVKHKVSELDIEIQ NIVSGLVDQKVAGIAAKAAPTNS DDMSSIGGSKTVERLTDLTVEEA TELARTNPAKYRQLVQRG (SEQ ID NO: 50) | 109 | No significant similarity found. | | | | No putative conserved domains have been detected |
| 41 | 18485 | 18748 | MAHEVTKIADLINPEVIGAFLHQK MLDNLVLAPFAEIIDRTLQGRPG DTLTLPQWNFIGLAEDLAEGEEL QSVKLTAEDRKATVKKGC (SEQ ID NO: 51) | 87 | putative major head protein, phage associated [Streptococcus phage 370.1] | NP_208925.1 | 4e-13 (36/85) | major head protein | No putative conserved domains have been detected |
| 42 | 18825 | 19292 | MAIAGKIDNDLFAAMRALTPSDV EITDSYEWWLDAQVAFGEEFDE ETYLFISPKRRATILKSKOFVHIQ QGVSVIKGHLGEIYGMNIVVSNK IGENEAFVLKRGALTLLMKRDYM VEEVREGMKRQTNTADQHYVA FVKDAKRAIFINKVAAGK (SEQ ID NO: 62) | 155 | ORF015 [Staphylococcus phage EW] | YP_240157.1 | 1e-15 (55/161) | | |
| | | | | | putative phage major capsid protein [Staphylococcus phage PH15] | YP_950669.1 | 3e-15 (59/160) | major capsid protein | |
| 43 | 19447 | 19884 | MAKTYNIYQDEVKVQEGVAELT KTITGLTPNTSYKFEVTAVEEGV ESAKSTAVTAKTNPRKVATVTAS QKTMSLASDGSKALTFTVAPED ATNKELEITNSNPEFATYADGTV TAVVAGTTITTATAKDGSGATAN CVVTVQAPA (SEQ ID NO: 53) | 145 | hypothetical protein ABC1334 [Bacillus clausii KSM-K16] | YP_174833.1 | 8e-18 (64/144) | major tail protein | |
| | | | | | major tail protein [Staphylococcus phage phiSLT] | NP_075510.1 | 5e-11 (51/148) | | |
| 44 | 19945 | 20349 | MELIENTELFKSFEDVTLPPETE AIDITDLKLMLGYGNSTIRDNVLK VLKKRARQHICLFINKEVTDFPM ELDYIADELTASRMSQLNSEGLK TESTDITRYDYKDDYANWYGIL NRWLEQQGEYRNKAFFML (SEQ ID NO: 54) | 134 | hypothetical protein ul36_44 [Lactococcus phage ul36] | NP_663678.1 | 0.007 (22/70) | | Fibronectin type 3 domain | cd00063 | 0.010 |
| | | | | | | | | | No putative conserved domains have been detected |

FIG. 2H

| | | | | | | |
|---|---|---|---|---|---|---|
| 45 | 20365 | 20742 | MRYNDIVDLIQFNDWEDPDDDY GTISYKTRGTIVVKDLFVSVGSL RVQGKLLQNQDQQWEKRYLIQ HKVFELKNLRVDAVRRHSTGEIL NVYWDNTTGTDQTVSYKVEYR DIRRDKEDGVIWQGS (SEQ ID NO: 55) | 125 | No significant similarity found. | No putative conserved domains have been detected |
| 46 | 20727 | 21107 | MAGFLEITKRIDFAGLEREFVNE VKGVVEKNSAQMATAVRLNIVR RGNIDTGTYYDGIKSKTEVEGKG KSVTGIVESDVSGNPYGHRGYA VYLEEGTYRHQAFPNFTDALEE YSDILVEQLSRIKV (SEQ ID NO: 56) | 126 | No significant similarity found. | No putative conserved domains have been detected |
| 47 | 21120 | 21551 | MSNRPPFRAR8SSVALQRAIVK EIRAQGHNVWDGTNKFPEYPFIKI GEELTSGRTISKDAIGKMHNLTL HWSDYDSSFEVKSLTDFLVDLLI NSPLNLEDGFCIGEKSLDHVRYT EAANGTYKNERAYLFLDFEVIDS TIEP (SEQ ID NO: 57) | 143 | gene transfer agent (GTA) orfg8 [Rhodopseudomonas palustris BisA53] | YP_780804 0.1 | 0.008 (28/98) | No putative conserved domains have been detected |
| 48 | 21577 | 22266 | MEACKSSYIRGTAVLIEVQNDLG EMKVAAQRGGTLNRTAATLDV SNKEGFGWDDAEAGNKSWSID CDGLFVEDNAGFQALNAAWVN GDCVRVRVKFPSGLTYVGQAIL TDFPYEFGYEDAVTYSLITFQGK GALEEQQVAPTILPKKVEFTNET KEVYKVGETLQATIKFTPENVSDQ SVTYTALTPALATIDESGLITGVK EGTASFNVRSNVNTAVSALIDIE VKPAG (SEQ ID NO: 58) | 229 | hypothetical protein PTH_2181 [Pelotomaculum thermopropionicum SI] | YP_0012127 31.1 | 2e-16 (47/131) | major tail protein | PhageMaj_T ail, phage major tail protein, TP901-1 | pfam10132 | 2e-20 |
| | | | | | phage related protein [Bacillus licheniformis ATCC 14580] | YP_078735.1 | 2e-05 (31/85) | | |
| 49 | 22411 | 22776 | MIIRFQGKDLNLRITYKSIHFLFI AFDQDYASRAEQTPFNQSLYIF WAMLQNESDYEGVSVLDVAELL QDSLDSYEFTLEEYFEKVNSSY ASSILVKQLFKKQHMLVTQRRR KTRTSFRS (SEQ ID NO: 59) | 121 | No significant similarity found. | No putative conserved domains have been detected |

FIG. 2I

| | | | | | |
|---|---|---|---|---|---|
| 50 | 22791 | 23087 | MVLCSDLGIPSSDRWTSTPYEF NGMLRGAYQRQSREASLFLSLV QSKKPVKLEKYQGFELVNETNK PKTTRDMAETMDELDRAAFKEE ELSNLFDYFD (SEQ ID NO: 60) | 98 | No significant similarity found. | | No putative conserved domains have been detected |
| 51 | 23100 | 24734 | MADKEMRIKVRVDNSDYASKMK DMEGTQSRLGKSTEQTTGIFGK FFNKLNGGASLANSSMLGLGKS FLSTSVGFGTLTAAATPMAAAV MGAAEATKVAGRFAMDSIKDYA NFEGTLKQVQIIAGGTQADMDM LGDTAIEIGGKTSKGAQEVAEAM VDFAKLGFTAKETSEAMKGIVYA AEASGSGVQETAGIVATALNVW NLKATEAEHVADVLAKTANETAA DMQDMGYVLQYAGSSASLAGA SLEDLSAMAGIMADNGIKGSKA GTSLRTAFTNLINPTDGAAAAME SLGVQFKDAEGKARPTMDVIYD LQDAVKGMDDIQIQELSTILFGK PGAAGMSFVLKSTKEQVQDLSK ALVDSTGTAAKQAAAMRETMAG QLDQLGDSVDAIKLKIGRAFTDM FALDAVKGFNKALDGVDEGLSN FGKGFKRTSDLLETSNGLISGTK DANKFVEAVRDAGTNLTNIPFQE SLAQSQVWGIGISKRAYETNEV MYQLNKSIQEFSFLPDDWEGKW GQASTILKDSVGQMELKLASAA AKGKHGGRS (SEQ ID NO: 61) | 544 | tail length tape measure protein [Staphylococcus phage phi2958PVL] | YP_0022680 17.1 | 4e-56 (131/349) | tail length tape measure protein | No putative conserved domains have been detected |

FIG. 2J

| 52 | 24718 | MGGEADISGIMNQTIQENLPALQ<br>TALDEQVAVFGTANQSRLDALQ<br>TFFTNEKTLTDEQKSIMIQGELT<br>HGQQLSDTIQTNNNKLELYQSM<br>GQQDYAQRQETGAAINALQQQ<br>NSEILQNIATTESSSIVETLRAQA<br>SSTGTTTQQMANDSIAAANQQY<br>SETVAAASKQYVETVSSINHMS<br>DESIAAAGTTRDELIEKARQQMV<br>GTVDHAKTQKEQTVGEIQKIADK<br>SEEVDGTHQINADADTTSAMEE<br>LGQLAARINDVFRAFGETAGKIQ<br>GGIDGFESKLKQADNWIAGKVG<br>GIFKARGGLTSGVGYGIGGGNA<br>QYSPMATAVGVGTQLGQGGIN<br>QGV/HNERGREVTMPIQNATYM<br>RPFAAAVANELQAMGGGLGGG<br>GVQEMVFLYINDREFARATNKA<br>MTEEQQRVKRIANRAVGKKVKE<br>TFK (SEQ ID NO: 62) | 428 | minor capsid protein [Enterococcus phage F4] | ABs60440.1 | 7e-80 (151/173) | minor capsid protein | No putative conserved domains have been detected |
| 53 | 26001 | MTCSNKPNYTFFKLQGLAPTKQ<br>WGLGRSASYERFNPNEFHALED<br>EVKITFPVDFRGKVKGNSNPNP<br>SRGFSHASQIYRENVLRGSQFL<br>SKPSLLFNGAVYNEKTVYNGAM<br>VASTQEVNQGLMFYWEDFINPD<br>PRIKEGDMVTFSVDVRSTGEDIP<br>TGAVAFKGTSNFEEYYKVLEQPI<br>TKEFTRISFTTRFLSKDWEWDE<br>AFGMFWGAENVPVTDYPMFQY<br>DKDKLVGFIQAQESVQLEFSRP<br>MVSTIGKTAYIESGDDMFSNNK<br>WDWSKAVSKGRLNEFDGKYNT<br>NGIKQDWAMPEFIPIFKGSERIH<br>FYKKTLTETTDAGHGYGKILFY<br>SAANEDSYMNVYKFPHEAGVY<br>GGYAAEVEVPIGATHYRVHITSE<br>RGSATTEAYYQSSANDWSEFS<br>QEWYDGLSGKLDGKTARAETFY<br>RKEMVEMEFELHFAEAVQKALP<br>NIFKDLTTDAEKQQRLRDIAYQF<br>DSTMIARGRGQGNNLADWIFYR<br>WAPDGSIEEQTMKQFRGEGLTS<br>VTHPSSYQEWNPQGRIYTSLRS | 1330 | phage putative tail component [Bacillus cereus subsp. cytotoxis NVH 391-98] | YP_001375814.1 | 2e-20 (131/533) | tail component | Siphovirus tail component protein | pfam05709 | 2e-15 |

FIG. 2K

FIG. 2L

NRIIPNSMYMGTDTLSGKYDPKL
TTLQLEVNGELVDKKAALDKTSE
VFTFTGLKGFLKPEDKVRIAGW
NNRINQWSITYSNVLMGNTPEN
IAEFNERAFVEADYLVTNMSVIV
TQSQMDEWQFNPNLPDYRIESL
ERPASRTEEYMINSMVQVTHAY
DIYGFIESNYPEFYGDCYTFDDR
IRKINERIKQFNIVATTYSEEPWE
DGDPTTYICAEARNPDRDYNVTS
EINQTVELQINNSKGHFIHPNGYI
YVGFARMPRSDRETGISVESEL
SFDFTMDRQYDSLPRVFRYNYQ
KQPWFLFVRNINRSVLAPKVNTL
TPINGGTRRYNFGATEDARYISM
DCFIKAPAEEDMPKLMEELADFL
DVGETVIQFSDNKDRYYKVILDG
STDLSQTLHVGTLTLTFVLLENT
AIGEEVVESFDIDSTTGSVPFIEL
ENMGTADAYPTYQLTFEEPVGY
VDLIGTDTSANVSIGRRPKDTED
EVKVDLRPRKFYSKFTSTDGAG
WTAMNDTQLPQIEGYSTKLQGT
VQRVNGMANQDKWNYGDTSH
RGWHGAGIVANLQKNLDDFVMI
EASIVATGKPVKTSANAIFLIFYD
ENNNPYAYTKVGTRPQEGNILDS
YVAYAGDWGKRKVVNNGAKWK
DFWGKVSVQRRDNRWRLIVGQ
YKDRRYSFSPEASFNFGQNMLK
DTRDTGWFDLPPETWGKKFAR
VGIFFGQYSHRPKLGHLSVRRL
VVWENLEEYGEKPLEGTPILFHE
GDTVVIDSSKAQAYLNGELTPSL
VDPMTDWFPITKGDNYIGINNFK
GKLDIVYNERFK (SEQ ID NO: 63)

| | | | | | | |
|---|---|---|---|---|---|---|
| 54 | 30006 | MITVLNANGQTVAHFVNNVSEG VPYFEPTLTENIETLVSTFSFSVP LDCDESQYLKGLNKVLVKDKDG DLRQFNIIHTEEVFQEVDSRILVE CEDFSISEMNDTVIYPFNGHNLG DTLTKAVKGTGWGIEYSADTWQ EGEEPFILAEYTNMREVFGNIQK TYDVDFKFTAERTAFNQTKRIVK VYKKQRSSNRPLLHL (SEQ ID NO: 64) | 198 | phage minor structural protein [Paenibacillus larvae subsp. larvae BRL-230010] | ZP_0224071 4.1 | 3e-08 (49/192) | phage minor structural protein | No putative conserved domains have been detected |
| | 30602 | | | hypothetical protein PEPMIC_00050 [Peptostreptococcus micros ATCC 33270] | ZP_0208331 5.1 | 4e-25 (71/155) | |
| | | | | hypothetical protein P9_gp44 [Streptococcus phage P9] | YP_0014692 24.1 | 2e-07 (59/217) | |
| 55 | 30631 | VQYNTKTAILPYYTGVDGKVWT LKGMWPVNPIEGITKDKESPLVV HNQAHADYDEPFFFKAMPFKAS STNPEQVYRQGVEELLKHIAPIY TYTVNVILLNRVQGWEGETLAL GDTVVWMKERVGSREIGLEARVI EYIYHEDDPSLDEVTFTNFREID TYDTSDIAGIRDALNDLKDQVDS NTVIIETTREQISKLEEGQSGIIED LGNKNSIGDTPKPNPIDGDTW FSTRVNEAGGTIHEIKVVWDGVE KVWKLSMDTSKAFEAEDTAKAA QKDAEESLDKANQAVADADTAK TAAQEALDRYNNLMISGRNLAL NSQKITVPDVVAGTTTRRKTIPL SIPTKLGTEYKLKFKYKLTEGTLP EGITVGIYNVPKLAWASNIVTIPT EGKDEGELFAELTTNATEGDVLL IYQGVRSAVKNDDNFDFTEVYL VEGDKIGDWQPAPEDAIASITNI NGEITSLVTKTDGLETSYSQISQ TVDEIQFTVGDKADKSQITQLQD QINLRVEKQDVINQINVSTEGIIID GAKVQITGKTYIEDAVITDAMISG LSATKLTAGVIDASKINVTNIDAS QIIKAGTIQGIIDIIGSKITNPFEIGS EGYTLAGQTVMERAQVKIDYSV SETGQKRLVNTSCKRYSKSAT (SEQ ID NO: 65) | 32562 | | phage minor structural protein [Paenibacillus larvae subsp. larvae BRL-230010] | ZP_0232903 4.1 | 3e-10 (63/225) | minor structural protein | Gp58-like protein |
| | | | 643 | | | | | pfam07902 | 2e-11 |

FIG. 2M

| | | | | | | |
|---|---|---|---|---|---|---|
| 56 | 32483 | LTTAFQKLVKKGWSILHARGIQN QLLNLDGTINSFSSLASDGLSIQ DSLGNSGYLSAELLMQFSNTGK KIYPGNSWVTNDRIVPSLTMNK CAIGWLFLWQPYDTTGGKPYT WDYTYYLVPKAHANFNSGKGIN MRLQGAGKGGGADDTVYKYVY VSNDSITGTVNNGTGNGAKWVL TGVFSV (SEQ ID NO: 66) | 183 | tail host interaction protein [Lactobacillus casei ATCC 334] | ABD83364.1 | 3e-08 (37/132) | host interaction protein | No putative conserved domains have been detected |
| | | | | putative host interaction protein [Lactobacillus phage A2] | NP_680496.1 | 4e-05 (37/129) | | |
| 57 | 33048 | LRVWIEDKVGLLTGYSTEPLEGY KCVNIDPSESLEMLGGMILDFHN YYYDGEKVYRDTNNDFQKFLEE EANKFPEPSKEEMEERLAKLEA LLADLL (SEQ ID NO: 67) | 95 | No significant similarity found. | | | | No putative conserved domains have been detected |
| 58 | 33383 | MVKLNDVLSYVNGLVGKGVDAD GWYGTQCMDLTVDVMQRFFG WRPYGNAIALVDQPIPAGFQFIR TTSSTQIKAGDVMIWGLGYYAQ YGHTGIATEDGRADGTFVSVDQ NWMNPSLEVGSPAAAHHNMDG VWGVIRPPYEAESKPKPPAPKP DKPNLGQFKGDDDIMFIYYKKTK QGSTEQWFVIGGKRIYLPTMTY VNEANDLIKRYGGNTNVTTYNY DNFGLAMMEKAYPQVKL (SEQ ID NO: 68) | 237 | amidase [Staphylococcus phage CNPH82] | YP_950623.1 | 4e-17 (49/134) | CHAP endolysin | CHAP domain | pfam05257 | 3e-10 |
| 59 | 34248 | LDVPHVYLRDTKDCSKITIGNLP TEPEVTVSAYREPSDITVGMIP VSFIEGDFDKYYEDFASDITKRL KDMAKLKEDSHKQAVDSINKEK VAEVVMFFE (SEQ ID NO: 69) | 100 | No significant similarity found. | | | | No putative conserved domains have been detected |
| 60 | 35006 | MAWIRTKENKLYKDADGNKVDT KDWKNAPLSMWNTTFMEYVA YLNQQKFGKVPINASLQTLRAIM KKDIERFGAEALKIFLEMAIKDYH GNSRYPTLSYSQARLLYMERFM SVALEKS (SEQ ID NO: 70) | 119 | hypothetical protein PlarI_22418 [Paenibacillus larvae subsp. larvae BRL-2300010] | ZP_02330367.1 | 1e-05 (28/98) | | No putative conserved domains have been detected |

FIG. 2N

| | | | | | | | |
|---|---|---|---|---|---|---|---|
| 61 | 35349 | MSIELSQKRFLPNNFNLPCINHK DENPKNIKVSNLEWCTHKYNS NYGTAIERKTK4SKPVRATNIKS GDVIEFSSMKAAHRAGFDESTIA QCCRGVYIQHNGYVWEFIEEGI (SEQ ID NO: 71) | 113 | prophage LambdaSa2, HNH endonuclease family protein [Lactobacillus rhamnosus HN001] | ZP_0321234 5.1 | 6e-15 (49/112) | endonuclease | No putative conserved domains have been detected |
| 62 | 35591 | MCYDGFIKDLRRGFIMEVWKPV VGFESHYEVSSLGRIRSLDREVY SEKRLIYEIS (SEQ ID NO: 72) | 55 | gp33 [Mycobacterium phage Ramsey] | YP_0022418 20.1 | 2e-04 (24/38) | | NUMOD4 motif / pfam07453 / 2e-04 |
| 63 | 36058 | MAKGLEAAQAAQAQSKG3SGEQ SKKTYLKKGQSIRARIPEDILENL HVNQVVSVFEPQVLPTLSYHAE GRTDVRDLYHEATEIMLADHRA KVESGEIERGSQADKDSYKAARI LTPKFLILFGVIPLADFTQGTKKT NTYPAGEPILLETNLGRDNANID ALTNFLSKETNAKKFPKAFEIT CEAANRYTFTPLDDEDLTPEELE VFKATEGATVPEEDFENAIFEST VERQIEDLKKIGFDTTRLPNLPTA APSPSQGADEAGTVDPSGIDF (SEQ ID NO: 73) | 274 | No significant similarity found. | | | | No putative conserved domains have been detected |
| 64 | 36934 | MKKDNPQVNPIKFTEEDYFRLL QTVWTNTFIGSLSAGYQGKER LEKITKIAENIMFVLNRLMESAES NGEDWGDEMLLDSLYSDSEVLY TKYKHLLSEAQLESINNSIKNFAE SAEKARKEAYEEKVAQAEVDFK KGQEEAR (SEQ ID NO: 74) | 143 | No significant similarity found. | | | | No putative conserved domains have been detected |
| 65 | 37489 | MLKEAVSESLWNAAYEILHTTM ATADKVIALVTVYNASNLEESTY AYEAIQDSVNKAICGGAVEDVK WKQFVGSLDSDYKEFFEKV (SEQ ID NO: 75) | 88 | No significant similarity found. | | | | No putative conserved domains have been detected |
| 66 | 37751 | MDYSKFKIGDTVMYQGQLQGA GTVINGNTYTVVQLTSKPRYAFII DEHGNKKLIQMGFNFAKIKEA (SEQ ID NO: 76) | 66 | No significant similarity found. | | | | |

FIG. 2O

| | | | | | | | | |
|---|---|---|---|---|---|---|---|---|
| 67 | 38192 | 38261 | GCGUUGUAAGUGUAACGGGCU GCAGAAUGGUCUCCAAAGCA UUAGAAGGUUCGAGUGCUU CACAGCGUG (SEQ ID NO: 77) | | | | tRNA1-Trp | |
| 68 | 38266 | 38351 | CGGGGAGUAUCAUAAUUGGAA AGCUUCGGUCUCUUGAAAACCG AUAGGCGUGUAAAAGCGUUU GGGGGUUCGAGUCCCUCUC CUCGG (SEQ ID NO: 78) | | | | tRNA2-Ser | |
| 69 | 38381 | 38506 | MNVESRNSEKAWNRAIVKAEQE AAKKKMERLAKMRAKSKRK (SEQ ID NO: 79) | 41 | No significant similarity found. | | | |
| 70 | 39337 | 39462 | MKDTVTISKSEYERLLKAEAFLE ALEEAGVDNWEGYAMAFF (SEQ ID NO: 80) | 41 | gp21.6 [Bacillus phage SPO1] | ACI91017.1 | 0.0019 (18/36) | No putative conserved domains have been detected |
| 71 | 39531 | 39731 | MILRIGFFWRSNSESLHCKSIEYI DMFQCGEEGYYKVVFKINEYTY EEHLPDSAYTAITLINKEEE (SEQ ID NO: 81) | 66 | hypothetical protein EFA_gp156 [Enterococcus phage phiEF24C] | YP_0015042 65.1 | 9e-10 (30/59) | No putative conserved domains have been detected |
| 72 | 39731 | 39943 | MNLGQLLDTVEYGTVRVRLVYYK STYNSDEYITTFVMSDTLEYTKA YELVEPHIEKRSNYNLQYSRWKI MC (SEQ ID NO: 82) | 70 | No significant similarity found. | | | No putative conserved domains have been detected |
| 73 | 39966 | 40100 | VETMYTVIYKNAVESEPALEGGS FLTDAPKTDGLKLMTFGTRVF (SEQ ID NO: 83) | 44 | No significant similarity found. | | | No putative conserved domains have been detected |
| 74 | 40168 | 40386 | VWNQWTLYWTDRETGEEQNFK IPRPNALFIGMPIDIDEYRYTVTA VSTPTKEVWTERIPFDFGTKPP WEHNN (SEQ ID NO: 84) | 72 | No significant similarity found. | | | |

FIG. 2P

| | | | | | | | |
|---|---|---|---|---|---|---|---|
| 75 | 40409 | 41353 | MLDTIHLTKDIQIHDIQEYLERFE WNRAKWTEDRLIAASPFRDDNH PSFFVNYNNDWAGTWGDSGTG DSGNFIQLVAELHETDYETALEM LKEEFMKPYEAPAISVKLSVKK EKSIFDIPTHNTSKYLLGRGISKD TQKLYRTSEDESKVCLPYINGM GLATALKYRRTDNKDFFYEAGN NHLKNMLFGYHVMYEKLPNTLVI CEAEIDAMTAYEMGFVGISLGAA NLIERQVDLIKKVDVKNIIGTDND EKGNLAAKSIDDAFWKTHKLFR YDMPSGYDLNLYWQEFHKAPPL KKISEPKLLRRKLWYIQ (SEQ ID NO: 85) | DNA primase [Bacillus weihenstephanensis KBAB4] | YP_0016427 82.1 | 6e-39 (106/314) | DNA primase | TOPRIM primases | cd01029 | 1e-06 |
| 76 | 41524 | 41757 | VAEFLGRTPESVKAKYYELRKQ GLLEYPSSINKKWTEEERQYVL DNYGKISNKEMARKLGYKTSQLI QLKWYHTHKK (SEQ ID NO: 86) | DNA-binding protein, putative [Listeria welshimeri serovar 6b str. SLCC5334] | YP_8494401.1 | 0.044 (23/59) | DNA binding protein | No putative conserved domains have been detected | | |
| 77a | 41833 | 42144 | MRKQTLLEKLKQVTGKTEKELN PTLSHIHIQLCGGSGTGGKFGAA KVPDYSDNFLFNSPARDTQKD VYKQLEVYVESFKRDFQKDGNI NQDERPIKKYLSME (SEQ ID NO: 87) | DNA replication protein [Paenibacillus larvae subsp. larvae BRL-230010] | ZP_0232877 5.1 | 1e-06 (27/78) | DNA replication protein | No putative conserved domains have been detected | | |
| 77b | 42142 | 42811 | VKIKVMEKTSTAAALLNEYMFMS WQASVILKTNMKQPPAYFLDVN SFQTLYNKFTRNGIAKDIAEKTS REYYEMMELAETAPLVVFDEIG NRSATEAFRADLHDIIINKRMVNIK LPSIFTSNHPIEYLEQVFDERLAD RVRERTMVYNFKGESHRGL (SEQ ID NO: 88) | DNA replication protein [Bacillus weihenstephanensis KBAB4] | YP_0016427 86.1 | 7e-34 (73/150) | DNA replication protein | PRK08116, hypothetical protein | PRK08116 | 9e-09 |
| | | | | DNA replication protein [Paenibacillus larvae subsp. larvae BRL-230010] | ZP_0232877 5.1 | 2e-27 (65/148) | | | | |

FIG. 2Q

| | | | | | | |
|---|---|---|---|---|---|---|
| 78 | 42623 | MASITAEMLLSKVINEMDVQALN RHGVSEDLFQSPIHKDAYNFIIKF SRENEGNAFSYQTLLQKVFELD YQSSTEESFTSLTKSLKNSRLQV DTAAFINKDLGEFWENSVKSDD PTEFINQTIAALEQIKAEHNVGGA SGRRLEKASEWVLEEFYKRKEG LSVKFWDSHFESLTELIGGGYQ SGNVYTWYGRSGRGKSTITLVE AIEAAVQGANVLMWVLEMPKYE FASRAISFISARDEVKKSRINGSD YLAGFNIANLTQATFDTAEEEQD FVDFINSLNDKLEGSITIRAVDDE DFMNRSLKQLERDIVENGADVV VIDPFYYLHYEKNTSKTAGGDAS QTSKALRLLAGRTKTVHAITQAE EDSNEKRRRA (SEQ ID NO: 89) | 377 | replicative DNA helicase [Enterococcus phage F4] | ABS50442.1 | 3e-139 (234/301) | DNA helicase | DnaB-like helicase C terminal domain | pfam03796 | 1e-04 |
| 79 | 43794 | MSLLEDAAYVLAFDSCDSRFAV EVVKGRSGNEGKQVEGIFLPVIG YVEESSDEAVTDVFEGIEF (SEQ ID NO: 90) | 64 | No significant similarity found. | | | | | |
| 80a | 44001 | MIWSLFDSGNGCYSQVFSEKE GVENYSIGMDKEKGTSKNHLNL DLADMSGYFGESNMIKSLENLP KPDVIIASPPCESWSVASAMAG GNACWNHLKGDPFTIRTSKEYE SVQFNHENSPYNRMNGELTVFN LIKIIKHFQPKIYIIENPAFGKIWEY IDKVLGF (SEQ ID NO: 91) | 165 | putative C5 methylase (MAV1virus-like) [Haemophilus somnus 2336] | YP_001784027.1 | 2e-43 (80/170) | C5 methylase | CyT_C5 DNA methylase | cd00315 | 4e-05 |
| 80b | 44540 | FEIKPTKFKSNINLNLKSENVKA GTEFRKASRIGGSYNVRSNIPLT LIDEIYKRIEEEL (SEQ ID NO: 92) | 60 | | | 3e-05 (29/60) | | No putative conserved domains have been detected |
| 81 | 44722 | MSFYLSQMNNLKEKIRYEKTSV KLIRESIERIGKPTGEYSLGYTDA LKMELLIHQKMLEDAQKELLDLE KERNK (SEQ ID NO: 93) | 74 | No significant similarity found. | | | | No putative conserved domains have been detected |
| 82 | 45019 | MTATKELMKPLVFKGIHSDIYEV SSEGLVKKQVD (SEQ ID NO: | 34 | No significant similarity found. | | | | |

FIG. 2R

| | | | (94) | | | | |
|---|---|---|---|---|---|---|---|
| 83 | 45116 | 45472 | LTDKLLKPQDSGYLHVRIPLEGK YYNARIHRIVAETFCERPAGGNV VNHINGDKKDNRASNLEWTQR DNVIHSIKLREEESKHLSMIEKM DMLLEKLIPSPEAKYNFMEEYVE WLKG (SEQ ID NO: 95) | 118 | DNA endonuclease I-HmuI [Salmonella enterica subsp. Enterica serovar Schwarzengrund str. SL480 | ZP_0266487 6.1 | 7e-10 (32/74) | endonuclease | No putative conserved domains have been detected |
| 84 | 454457 | 46485 | MAKGLTAINKAAGKTLVDTIAED FKRQLNKWQETGYTYDSEVIHH QLMRDYLKIVDRNPFEDFPENV PVFRSSGTGKCLREQTLFAIDKI EGSDRKDPPKMQAHQSRWVQI GTKVGDMIQEQVLMMEKNYRR FTGEDCHFRFERTEEGFPHFEE FSTTFKKYKSGRMEFITGGSMD GIMIWTDPSSGEEFRVGLEVKS KQTTPAATSAFSMRQIPNSKHV WQVKNYAMLKDLDLYLIVYVNC AHKSWEMAEEDYAKNPDLQVF GVNITEQDKKDVRNRFFTAIEHA HAGTLPPLELSGFTFSDYKYALA NSLTYKELELEKKAVSKFDQKA LEEIKKIRGDVK (SEQ ID NO: 96) | 342 | hypothetical protein BAT_0151 [Bacillus pumilus ATCC 7061] | ZP_0305412 5.1 | 6e-50 (116/323) | | No putative conserved domains have been detected |
| 85 | 46485 | 46814 | MNESIYEGIPEDILQEKFYGVFIK FRCDNRTKPLAMHISELSKEML DATYLQREAGESNILKDVNTGL EMAFDLTDIVVYSTKEIALGDTE AYYSFAEHMADMMLGDD (SEQ ID NO: 97) | 109 | No significant similarity found. | | | | No putative conserved domains have been detected |
| 86 | 46807 | 47385 | MIKIRFISFDVSSVSTGVAVIDRE PSGYLTLVHTDIISTNPKHNVGR RLKNFAEAVQILLETFRPDYVVK EQTIARMATQHILLKFAGVLEMIA SNEGPKYEYSPTTVKKVVGG HGRATKEAVLMGTTEYINWNEPI DLVIDDISDAVAICLTHIGKEFVLV PLGEVEKAKEEAMIVEAEASKYL EEATE (SEQ ID NO: 98) | 192 | crossover junction endodeoxyribonucle ase RuvC [Bacillus weihenstephanensis KBAB4] | YP_0016427 69.1 | 4e-17 (58/159) | crossover junction endodeoxy- ribonuclease | RuvC_resolv ase | cd00529 | 3e-14 |

| | | | | hypothetical protein SERP1509 [Staphylococcus epidermidis RP62A] | YP_189074.1 | 7e-12 (53/180) | Nucleoside / nucleotide kinase | Nucleoside / nucleotide kinase | cd02019 | 0.010 |
|---|---|---|---|---|---|---|---|---|---|---|
| 87 | 47382 | 47951 | MKQQLRIAITGTSRSGKDTFAQA IQKKLVEMGFAEAMPIAFADPLK QLYKRYFFYMEDKEKPRDAYVTI GNAMREVNENVWNNLLIQAAK DWDEGFSTLVTDVRFENEAKTLI NDYGFILVKVDADPLIRLVRAEAL GETLDLNNKGDIEVGMIEPHLTFI NNGESDLMQMDKYAEIINMAQE VANG (SEQ ID NO: 98) | 189 | | | | | |
| 88 | 47844 | 48096 | MANLLISEKSYYEKLVEAETANE FRMVJRLINFRVVMKVKVPLEVR ELFL (SEQ ID NO: 100) | 50 | No significant similarity found. | | | | |
| 89 | 48110 | 48601 | MYYERFGDVALPDSLANILSTYY MQDDTRGDLEGTNKFARCSKM EYSFASDKKEKRIRTEDLYKESP INLEVLEGNGYSRNNASSLDME RAALRTDLLKAMAKADLTEMEK KVLELNLIYDYTMREIEVLPEMP SRSTLSRIHLTSARKKDYATNLKY FQKGA (SEQ ID NO: 101) | 163 | No significant similarity found. | | | No putative conserved domains have been detected | |
| 90 | 48676 | 49161 | MPRTNNKISRKKALEVVLEGSN PLAAISELIEEHTWTYGFDMESA TFYKERTSNPYDTCKNPRCKLC KQIREHAERIPAYSLGKTLAKPF EELSLGHFGKLAANDVAKSDMP KLLKVSMKDINNHIEMLVEKNVM RQFHQPSKRLRVIRTSYPTAFR DWCL (SEQ ID NO: 102) | 161 | No significant similarity found. | | | No putative conserved domains have been detected | |
| 91 | 49163 | 49240 | MRQFKKRMYEGKKQRIAEAKKG EWA (SEQ ID NO: 103) | 25 | No significant similarity found. | | | No putative conserved domains have been detected | |
| 92 | 49240 | 49350 | MKQYIKIGAAILLILIGVAVWLIEFI LPFVLLKWAL (SEQ ID NO: 104) | 36 | No significant similarity found. | | | | |
| 93 | 49369 | 49563 | MGLLERITYSLFIALVVLAVGAF FVGVYWLAVWTSGLGLGLGTFV AVGIVMFVFPTALAVFLGFD (SEQ ID NO: 105) | 64 | No significant similarity found. | | | No putative conserved domains have been detected | |

FIG. 2T

| # | ID | Sequence | Length | | | | |
|---|---|---|---|---|---|---|---|
| 94 | 49577 | MKLKDLLEVVDFMQDISLEIAEL TAPEGYAKDIQKLRPMAVEMEV VDVHTAWYSGEDSIETTLGVVV TGGVKVMRKLFEENFTIDEMSE MWYGWDNEGLLYGWENGEAG EVYNILEENGYNMDSIKIMYGAF VTLGELVGAI (SEQ ID NO: 106) | 143 | No significant similarity found. | | No putative conserved domains have been detected | |
| 95 | 50225 50802 | MSLGMFDKELLAALAALRWVVE DPEIKERHDEILNTAYMENAYEK GDSFPDEKFVEWDFINALTTFEI EAAARGLITDDEAYDEEDDMDW ASDTYSCGCCTCCGCTCDYYM WEDDGSFDEDDLED (SEQ ID NO: 107) | 125 | No significant similarity found. | | No putative conserved domains have been detected | |
| 96 | 50606 50791 | MANYYVLKRLDDGSGKLHQVKC YKSLDKAIKYAKEMSTFKKTYQV AGQFDMNRRLANTGRLI (SEQ ID NO: 108) | 81 | No significant similarity found. | | | |
| 97a | 50988 52235 | MKNSAKDKERLKLVKEYLEEGK VSREEDKLNKMFSKAEALRIYQK VQEMEREAKFDEIRKKEWKKFPI INNIVELASWIDNALECDNEYLA MDFETVGDNGGTDMYREEISGF SLTYRYKGEIINGYVPMRHREED GSPSHLNIANVKWAEEGIKRVFE SDKATVWHNATFDMGLAKASLG IAFRTPVHDTLILMHLLDEDLPSY QLKVLATRFLNIPSDTFEEMFGK NAKFADIAVEIARVWYAGKDTYVG FLLFEWQLNILNKPSFAKIKKVYE RIERPCIMATFEMESEGFHINME EVEVQRKESEAELEEISARLQAR FGDVNFSSPSQLLKLLYVDNDW SKYVTPDHKSILRGHVGYNEHGI SNNKLFALMPNGSVILDPVVNAE GKVVPKNDRNKLQANAKAMKK DCQSC (SEQ ID NO: 109) | 415 | DNA polymerase I [Enterococcus phage F4] | AB850441.1 | 2e-174 (294/299) | DNA polymerase | |
| | | | | DNA polymerase I [Pelotomaculum thermopropionicum SI] | YP_00121271 08.1 | 1e-28 (90/255) | | |
| | | | | DNA polymerase I - 3'-5' exonuclease and polymerase domains [Bacillus pumilus ATCC 7061] | ZP_0305429 7.1 | 3e-28 (108/339) | DNA_polA_I_ Ecoli_like_e xo | cd08139 | 3e-27 |

FIG. 2U

| | | | | | | | |
|---|---|---|---|---|---|---|---|
| 97b | 52279 | LTAFVNKIDTFRAPDGKLHGQFN QFGTVTGRFSASNPNLQQQPKK ARKMFEAPEGSLILGADFSQQE PRLLAHSSGCQELINIYNEGRDL YSEMASAIFNKPIEECLDGSIYRK NTKMIVLAIMYGMGAYSLADILRI DAQEAQKMIDDFFVVYPEVEAW IEGNKKTVVKQRYVETLFGMRR RFKHENFDILKKELELLR (SEQ ID NO: 110) | 52881 | 200 | DNA polymerase I [Pelotomaculum thermopropionicum SI] | YP_0012127 08.1 | 5e-43 (95/184) | DNA_pol_A | pfam00476 | 1e-37 |
| | | | | | DNA polymerase I – 3'-5' exonuclease and polymerase domains [Bacillus pumilus ATCC 7061] | ZP_0305429 7.1 | 8e-40 (87/185) | | | |
| 97c | 52835 | MKTSTSLKKNWNSLDENDKKLR SAASRALRQATNALIQGGAASQ TKLVMNAARIRLKELSEARGEPN SFGFLAQVHDELLFKVPENVTQ QEVDAIEDVMINTVKLVVPSKTDI EKGKNWGKMTARKDWFK (SEQ ID NO: 111) | 53227 | 130 | DNA polymerase I – 3'-5' exonuclease and polymerase domains [Bacillus pumilus ATCC 7061] | ZP_0305429 7.1 | 7e-14 (50/121) | DNA_pol_A | pfam00476 | 7e-10 |
| | | | | | DNA polymerase I [Pelotomaculum thermopropionicum SI] | YP_0012127 08.1 | 3e-07 (37/100) | | | |
| 98 | 53302 | MNSLYEQFKEGTLKEGQRFSVT GTIVLIDAEDPALPLKVDIDGEGI KWLKEGAIKYMEPAAEKLYEVSI GGRLLSYYGSDYEEGKWTCFFV EK (SEQ ID NO: 112) | 53583 | 93 | No significant similarity found. | | | No putative conserved domains have been detected | | |
| 99 | 53543 | MKKGNGHAFLWRSREEPKDIFV QAFPMSFLEKHFPEVVEIAKESN KEEGGNAL (SEQ ID NO: 113) | 53704 | 53 | No significant similarity found. | | | | | |
| 100 | 53701 | MKRFAIITRIEECTPDEDLLELGK AYEIVNELYGGAHVYVDERHKR YFVDSHQYVEVAEGIFELTLGML LSKLDEDINTNLEISFEGRATKDV SENYYKDELKDYFDREVKMYSP DTVVDGLSILLEGGV (SEQ ID NO: 114) | 54093 | 130 | No significant similarity found. | | | No putative conserved domains have been detected | | |
| 101 | 54096 | MEIKVEQPKEIILLEVGWRYTSD WIVNSTTVSVEDNVYAYENACY KVLEELCESIDAKYIDICFVREAT | 54311 | 71 | No significant similarity found. | | | | | |

FIG. 2V

| | | ENA (SEQ ID NO: 115) | | | |
|---|---|---|---|---|---|
| 102 | 54304 | MPKKYYLKAISMYILYAFIAAVIIG GTFLLVGAFVWWGKYVYGRFGD TVGTILFLSTAGLIALCTALYYEA RKEFRKDALRVRIQDPEDGINTQ SHKIVYMLPEDVIRQASTIVGIIPK DIQHIESEELRKKGSPCHHEVFT SGVWIYAYHRV (SEQ ID NO: 116) | 153 | No significant similarity found. | No putative conserved domains have been detected |
| 103 | 54782 | MLREWDLNYTFKTRGKLMEKLJ DRGVGLDGEFLKYLVD (SEQ ID NO: 117) | 39 | No significant similarity found. | |
| 104 | 54957 | MNYEEFKKEIESIDYLSVENRYD RVLVYSSLGDYPLVAVSILETGF VDYNWRGHVRARDIPVLTEAVE KFAETPYEERFPKKLLPTYWRKL C (SEQ ID NO: 118) | 92 | No significant similarity found. | No putative conserved domains have been detected |
| 105 | 55180 | MRSVFQKNYYLLIGENYVSGITF TYFWLSADCEPEEPIEVTFNEAF PHLFTNRNKEQASKMLDAAKIK HTWEVV (SEQ ID NO: 119) | 74 | No significant similarity found. | |
| 106 | 55448 | VLLTELALIFWEEGSVHEVIKRN GTLIIDDDDTLGRGIRNSDDILSY LNLEYPVKNGSSGGRHHEKHW GTHN (SEQ ID NO: 120) | 72 | No significant similarity found. | |
| 107 | 55614 | MEVVEEGIMKSTGERITRDNIKE GMKVVGVKSIYESQGYFTVGKE YEVVMGNCGYLGIKDNGRDGFI WDCAIFNEDKFVFEILEEPSEKS FFKSFRK (SEQ ID NO: 121) | 97 | No significant similarity found. | No putative conserved domains have been detected |
| 108 | 55795 | MAVMDLSGIVQSLMKTSLSSRF WKSLQKKASILKALESKIRELNNH QQELFQKRDRINKQAIQLGSKA RRLEEAKALIEKYI (SEQ ID NO: 122) | 81 | hypothetical protein EFP_gp188 [Enterococcus phage phiEF24C] | YP_001504297.1 | 0.003 (24/53) |

FIG. 2W

| | | | | |
|---|---|---|---|---|
| 109 | 56135 | LWKALKKELSEQLSEDLTPADIT VLNIIPMDKKQSSLITGI (SEQ ID NO: 123) | 41 | No significant similarity found. |
| 110 | 56274 | MLTTDFIKAVEKIGLEVDNSYSS VLYVESHDGVVWSINKGCSETFT WCNGTDIHVGSLLELIPLVEEYA NTPIGEREKKVSEKPLESYPIEEL GEAISKILLNKHNPNAQVVISQE RIHPYEPKWSTPSEWALENL (SEQ ID NO: 124) | 136 | No significant similarity found. | No putative conserved domains have been detected |
| 111 | 56763 | MEDLFKFACTLVLMTVLISGYVAI QLVIIAVAGTFLPTWAFVIVLGWL VYTNYRVLLKGGEY (SEQ ID NO: 125) | 62 | No significant similarity found. | No putative conserved domains have been detected |
| 112 | 56951 | VNTVYQDTQDIYLKAFWICIDRA RNRAGVTWTYLQGGDTPRAING TANPSIKKDFAAYGQA (SEQ ID NO: 126) | 61 | No significant similarity found. |
| 113 | 57209 | MNILNGSEMSRLIYMVECQLAD VKQNLAFYQQDSISGSPGIIESLT EDLTELTRIKARLEVMLEQFEKL V (SEQ ID NO: 127) | 70 | No significant similarity found. | No putative conserved domains have been detected |
| 114 | 57434 | MDLTAEELTFLACLVENNNEEV QDSINIYKSFDKDAAAKVLEKQL LESIRLASRLREESKKSMLIGGL SIC (SEQ ID NO: 128) | 71 | No significant similarity found. | No putative conserved domains have been detected |
| 115 | 57643 | MLIKKEKKAYLFTIYGLHSYPSM GVDSYSDSVAMERFYKIWRKHY PKHYKTHKEFTVKKFDI (SEQ ID NO: 129) | 63 | No significant similarity found. |
| 116 | 57897 | MIPEGTYLKDSSGLNHYFIEGHI VGVRTGVRGYQTVVWDKELDK NV (SEQ ID NO: 130) | 46 | No significant similarity found. |

FIG. 2X

| Phage | Titer (pfu/ml) | Phage sensitivity (%) of EFS strains (n=105) | | | | | Total of infected strains (%) |
|---|---|---|---|---|---|---|---|
| | | ++++ | +++ | ++ | + | - | |
| F168/08 | $6\times10^{10}$ | 22 | 11 | 10 | 4 | 53 | 47 |
| | $6\times10^{9}$ | 19 | 14 | 8 | 3 | 56 | 44 |
| | $6\times10^{7}$ | 16 | 4 | 2 | 3 | 75 | 25 |
| | $6\times10^{5}$ | 15 | 1 | 0 | 0 | 84 | 16 |

FIG. 3A

| Phage | Titer (pfu/ml) | Phage sensitivity (%) of EFM strains (n=56) | | | | | Total of infected strains (%) |
|---|---|---|---|---|---|---|---|
| | | ++++ | +++ | ++ | + | - | |
| F168/08 | $6\times10^{10}$ | 6 | 5 | 5 | 0 | 84 | 16 |
| | $6\times10^{9}$ | 4 | 6 | 4 | 2 | 84 | 16 |
| | $6\times10^{7}$ | 4 | 2 | 0 | 1 | 93 | 7 |
| | $6\times10^{5}$ | 2 | 3 | 0 | 0 | 95 | 5 |

FIG. 3B

| orf | Start position | Stop position | Product aminoacidic sequence | Size (aa) | Homologous/similar proteins ||| Predicted function | Conserved Domains |||
|---|---|---|---|---|---|---|---|---|---|---|---|
| | | | | | Name[organism] | Acc No | E value and identity | | Name | Acc No | E value |
| 1 | 53 | <3 | MKKRLEELTPDELQQYA (SEQ ID NO: 131) | 16 | hypothetical protein EFP_gp173 [Enterococcus phage phiEF24C] | YP_001504282.1 | 3e-08 (17/17) | | No putative conserved domains have been detected ||| 
| 2 | 511 | 50 | MEDKDYALALAEEDTGVWKA CETFPTREEAVSAGKLALLS INEGKTYVDSLGMHVEDIFG ALPEKGATSFAVGQFNKAVI SVDVVGMLESVGEQLYSEY GEVAEDYYPTDEVSDEAIDE LHDIIANWLNKNLTQPPSFG SVDDVEKITLEGENK (SEQ ID NO: 132) | 153 | hypothetical protein EFP_gp174 [Enterococcus phage phiEF24C] | YP_001504283.1 | 6e-80 (147/153) | | No putative conserved domains have been detected |||
| 3 | 701 | 525 | MNNLTAQDLLDELLELKDQ GHALEDYIVVGEPINPYDHY LEFDGWHLDSNTNMIILKG (SEQ ID NO: 133) | 58 | hypothetical protein EFP_gp175 [Enterococcus phage phiEF24C] | YP_001504284.1 | 3e-17 (52/58) | | No putative conserved domains have been detected |||
| 4 | 892 | 698 | MNVLKQYIKEVHSVTPYTED WTKHDKGFLMVDLTVNCYG SLSRREHLFYYDEMEEAKK KGYYMA (SEQ ID NO: 134) | 64 | hypothetical protein EFP_gp176 [Enterococcus phage phiEF24C] | YP_001504285.1 | 4e-23 (54/65) | | No putative conserved domains have been detected |||
| 5 | 1326 | 889 | VRDEKEVNYFIETLAEERKK KWNGYLTSLRDSVTLREIRT SYSVMTGAYIVFLYIYNYDL NKRTIVKATLDDWRMPYVD LGEFEYFRELGKMYDDKVR EALDLYVRQIGRSRPESKAL GIRRYKEVSRNNRTQTRKF KPRKGHVK (SEQ ID NO: 135) | 145 | hypothetical protein EFP_gp177 [Enterococcus phage phiEF24C] | YP_001504286.1 | 5e-76 (140/145) | | No putative conserved domains have been detected |||

FIG. 5A

| | | | | | | | | |
|---|---|---|---|---|---|---|---|---|
| 6 | 2101 | 1418 | MLLNKHWNSDEEDLILLQDY VDRGSKSAEVLGFVYKHILN GGTALLGNHDQMILDFLTF PLIREADYEDLSEMYAMWM YNGGDKTISSLLDLDEHLQD AFTTRKMLLEKTNVVEVISLL EPYYEHGDTLCVHAGIPVYR QPDWKTATKDEMIWTRPLA LQKNKTDKTIVMGHTPTINL RKENSYDVFLGDRSIFIDGA CAYGGQLNAVVVDSKGSLL NTYKQESLSK (SEQ ID NO: 136) | 228 | putative serine/threonine protein phosphatase [Enterococcus phage phiEF24C] | YP_001504287.1 | 4e-131 (227/227) | serine/ threonine protein phosphatase | Putative protein phosphatase | PHA02239 | 1e-08 |
| 7 | 2634 | 2165 | MTMHTENLLAVTIFLLIQMAV VAFIFTKGIIVYDRLLSEYRD VVGIAFSILLFGNGAMLIIHQ VIAIFSIWFNNSFRESDVFLA QGYFIVLLLYIALNVYGSTL FKNIRVNIKNYINYNARSKNY KLALVIVITFIVNTVLVLATYW LAEVVKGAIIH (SEQ ID NO: 137) | 169 | hypothetical protein EFP_gp179 [Enterococcus phage phiEF24C] | YP_001504288.1 | 1e-82 (158/159) | | No putative conserved domains have been detected | | |
| 8 | 2889 | 2638 | MKPDYSSIIGKRFIPKKRYPR ILMKEVYPTRVFYDFFRVLP WEKAPDIPLRVKFVEFTFIH EGRVEKERYTYYSFTHFE RSG (SEQ ID NO: 138) | 83 | hypothetical protein EFP_gp180 [Enterococcus phage phiEF24C] | YP_001504289.1 | 3e-39 (82/83) | | No putative conserved domains have been detected | | |
| 9 | 3497 | 2886 | MGREYYISDMHFFHRNICG EASFMDTRKQFKDVEEMNE YLINEWNTTVRPEDVVYHLG DFAMGAKVNSIANVLERLN GTIWLIKGNHDNSPLRKEIK RNTSLNDRVHWEDVGIILKR MHKVVHMTHYPLILGDRGN LINLHGHIHELARPEPNLLNV GVDSPELDNHKLGKPLLLED AIRLVNKKQVNFNKASRAYS IHGDLQ (SEQ ID NO: 139) | 203 | putative phosphoesterase [Enterococcus phage phiEF24C] | YP_001504290.1 | 5e-98 (176/180) | phospho- esterase | Phospho- esterase or phospho- hydrolase | COG4186 | 6e-17 |

FIG. 5B

| | | | | | |
|---|---|---|---|---|---|
| 10 | 3860 3510 | LNVLYYVIILTMAHAVGDYAL QSDYIAKGKQTDLYLIIHVNI WTYIIVATTLFLGTPVKLGLIV VCLWVPHFIMDYLKAQSAW FLKTVPNKKTQLIIDQTVHYL QLAVFWFATH (SEQ ID NO: 140) | hypothetical protein EFP_gp182 [Enterococcus phage phiEF24C] | YP_001504291.1 | 4e-42 (84/116) | No putative conserved domains have been detected |
| 11 | 3973 3857 | MKLVTCPECGGNILEGAPN EYGFEQDTCPYPYKEEDLI (SEQ ID NO: 141) | hypothetical protein EFP_gp183 [Enterococcus phage phiEF24C] | YP_001504292.1 | 9e-13 (35/38) | No putative conserved domains have been detected |
| 12 | 4693 4280 | MTYRMKCVITNFQEPFTE GKEYRIAHNNTIGYFIKDDD GTTAESGKTRGELLNKLNE YWYSQFELEIEPKQPINECT EIRKKFQCTLIQYNMDIGHL EGRLVGKPSNIISTQIAMLKV KREAVQELYDELFKEDS (SEQ ID NO: 142) | hypothetical protein EFP_gp186 [Enterococcus phage phiEF24C] | YP_001504295.1 | 7e-50 (98/137) | No putative conserved domains have been detected |
| 13 | 5081 4695 | MTVKIRCTLKTEHIFTEGKEY DVFYDDARGYFLRDDEGDII ESGATPELLLAELNNYWHS KFELLGAEPKKLTLYLGIDK GTGTNMAVGTSLQGVLEKV KELDIYFSSDSDFYANYKSQ YIIEEWETY (SEQ ID NO: 143) | hypothetical protein EFP_gp187 [Enterococcus phage phiEF24C] | YP_001504296.1 | 1e-64 (121/127) | No putative conserved domains have been detected |
| 14 | 5358 5083 | MTKLSSAWLVKFEYRAVKM RAFTSYDKAVTYNEMVQNI DEQIEESYYETKTTYTDDHK PLLTQFIYWNEDRTFRNILG FVSIKIEILEEN (SEQ ID NO: 144) | No significant similarity found. | | | |
| 15 | 5548 5321 | MIRKQLLFELEVEVDEPMVG RNGYRTVMQTTRLYAYSLD DAYHAFRENHRYMIKSIKEVE EEINDEIKLSMVSEI (SEQ ID NO: 145) | hypothetical protein EFP_gp189 [Enterococcus phage phiEF24C] | YP_001504298.1 | 1e-27 (60/61) | No putative conserved domains have been detected |
| 16 | 5811 5638 | MRIRKHANKIIGWLFIFLAVL TIVKWVLGKPLDGFDIVLYVL LQLLYGMEKLSNDE (SEQ ID NO: 146) | hypothetical protein EFP_gp190 [Enterococcus | YP_001504299.1 | 2e-23 (56/57) | No putative conserved domains have been detected |

FIG. 5C

| | | | | | | |
|---|---|---|---|---|---|---|
| 17 | 6145 | 5301 | MNELDGISKLEADIIKTTQLL ETQQELKKNFIRNEKLSKRN YELSIDVLKLRNTLLDVMED LDNLMENVEGIIKEDANKHS KVEKEMVKGWLERTGKLAN ETRKNIEEVLESYEN (SEQ ID NO: 147) | hypothetical protein EFP_gp191 [Enterococcus phage phiEF24C] | YP_001504300.1 | 7e-55 (111/114) | No putative conserved domains have been detected |
| 18 | 6399 | 6145 | MVLTMNKPVRATSEQVVYR EEYANGWAVEVIHSLKGFG HIYVENKPYSVAIMKPAENF ADYSTVGTAEEVLKLIEEVV EYEEDM (SEQ ID NO: 148) | hypothetical protein EFP_gp192 [Enterococcus phage phiEF24C] | YP_001504301.1 | 1e-40 (82/84) | No putative conserved domains have been detected |
| 19 | 6634 | 6380 | MTIIDYGSKPLNNCSKNELL DIIQSCLENEVKLIKLIERTTK EVEEEKEVPHYKNYISPEKR SYLEGMERVENIVRNFYGF NNE (SEQ ID NO: 149) | hypothetical protein EFP_gp193 [Enterococcus phage phiEF24C] | YP_001504302.1 | 2e-40 (84/84) | No putative conserved domains have been detected |
| 20 | 6980 | 6645 | MNYRIVSYENSQEWLDAFN EFSGGNSFKMINEAIHPDIYEPI KTAVLLFNHEVAEGEAIRLE KIDESEEDTCDHTYETYAVQ TGYSSIDIEQAGFCTKCGHD THKGVKEYTLK (SEQ ID NO: 150) | hypothetical protein EFP_gp194 [Enterococcus phage phiEF24C] | YP_001504303.1 | 2e-58 (108/111) | No putative conserved domains have been detected |
| 21 | 7392 | 6955 | MNNEVEVPKCVKEFIDKQR EQLMDKLQIILEGQRYSCEY PKSEFSKWFFANTDTFIQAV ANTASLPKYYVVMPEKQKR DYGILLRKDGKLAVSILPRN EPLSQDTLSKLKDYYLTEAEI KEIDERYWLFKKTREELSYE LQNCII (SEQ ID NO: 151) | hypothetical protein EFP_gp195 [Enterococcus phage phiEF24C] | YP_001504304.1 | 2e-76 (137/145) | Protein of unknown function (DUF1642) | pfam07852 | 3e-04 |
| 22 | 7869 | 7408 | MGKQILKGWWTIDNSPGAE TNEPYLIKEVKEIEYHHEH RALNMLICNALHALGAEDTT TEEEYDGGISSKYHLDNAEI QIFSAVERTSLEDTKNIVLK SMGVLDFEEGWYGWSSFTI EGFETNTFKLGGHDILNIVR QLEGKYVYTTIDKV (SEQ ID NO: 152) | hypothetical protein EFP_gp196 [Enterococcus phage phiEF24C] | YP_001504305.1 | 3e-77 (138/153) | No putative conserved domains have been detected |

FIG. 5D

| | | | | | | |
|---|---|---|---|---|---|---|
| 23 | 8089 | 7862 | MELMIEGVSRGEFSKQFIKV SQTTEATVDIAVINRTVEVFR PDCVHEQTVLTKENLDLLV TAIGYTKERMSNHG (SEQ ID NO: 153) | hypothetical protein EFP_gp198 [Enterococcus phage phiEF24C] | YP_001504307.1 | 3e-29 (82/72) | No putative conserved domains have been detected |
| 24 | 8508 | 8077 | MFYKIIELMAELTKEIKEIKDT LGCSMPIAEDRKVTRIAYLS EQLDDLNSLLIDIPVNYHET WLLDEPLTQNTPYEFHIEVM VLPYGEMGVDVKCYYEEVA SSISLGVDEFRTLPDTVDEL QERTFHNFHGLSREEAINK WSL (SEQ ID NO: 154) | hypothetical protein EFP_gp199 [Enterococcus phage phiEF24C] | YP_001504308.1 | 6e-78 (141/143) | No putative conserved domains have been detected |
| 25 | 8741 | 8511 | MSKELISCGACNEVFSEMD EVVRLTDDSMYHKDCVTLY STGYCAFLDDEYLGDTENG EGEPACFFLEEGEYIEEEE (SEQ ID NO: 155) | hypothetical protein EFP_gp200 [Enterococcus phage phiEF24C] | YP_001504309.1 | 7e-35 (73/76) | No putative conserved domains have been detected |
| 26 | 9169 | 8738 | MGLTKIETREWYNSDLDKL HKEGRDIYVKLKIGKRLTYG EYEREPNINGFQWINNEDTLP LILDNYEVYTETTTELTEKQL IVLVMLIHYLERTKLTIADSL HNLISGKANDATLQVWADL SSVEEAEVIRELVDYVIDKG GSL (SEQ ID NO: 156) | hypothetical protein EFP_gp201 [Enterococcus phage phiEF24C] | YP_001504310.1 | 5e-69 (140/143) | No putative conserved domains have been detected |
| 27 | 9325 | 9173 | MANKVSLENLLAMAVTAKE HEMSRHANKMRQLEKTEAN IKKRIKELSKEG (SEQ ID NO: 157) | hypothetical protein EFP_gp202 [Enterococcus phage phiEF24C] | YP_001504311.1 | 1e-18 (49/50) | No putative conserved domains have been detected |

FIG. 5E

| | | | | | | | |
|---|---|---|---|---|---|---|---|
| 28 | 10272 | 9325 | MDFDKIYKDLVMDIIKNGVT ELPEGTRAVYADGTPATTKF IEGVNFTTPDMGAPLLRSK HVGIIKWALTEQMWQEMS NEVSWLKERGVTIWDEWE QEDGTIGKAYGYALFNKERF IPVYSGDVELAKNRKAGSLI PKVVPKKGGWAGTHQPYL KLNQVEAVIEQLKSTPNSRR IMTTLWRVEDLYDMSLEPC VWTTHWTVVEGKLNLHVKA RSSDVCLGLPFNIIQYHALQ LVMANTVGLELGNLYWTSD NA (SEQ ID NO: 158) | 315 | putative thymidylate synthase [Enterococcus phage phiEF24C] | YP_001504312.1 | 0,0 (313/315) | thymidylate synthase | Thymidylate synthase and pyrimidine hydroxy-methylase | cd00351 | 3e-44 |
| 29 | 11375 | 10392 | MNLQEKYEGINWNKIDDVID QATWKKLTEQFWLDTRVPV GNDVNDWAKLSDMEQDLIN KVFGGLTLLDTVQSESGVH SLLDDVRTQHEEAVLNNIAF MEAVHAKSYSTIFSTFNTPT EIDNIFEWWATNKRLQYKANI INDIYRNGTPLGKKSASVLLE SFLFYSGFYTPLRYLGEAKM VNTAEIIKLIIRDESVHGTYIG YKYQLGFNQLPETEQKEME QWVIDLAFKLWENETQYTA ELYSEIGWTKDVNTFL (SEQ ID NO: 159) | 327 | putative ribonucleotide reductase [Enterococcus phage phiEF24C] | YP_001504317.1 | 0,0 (327/327) | ribonucleotide reductase | Ribonucleotide reductase, R2/beta subunit (RNRR2) | cd01049 | 3e-63 |
| 30 | 13538 | 11388 | MNTYIELNNQLNIPNNGKIQL DKQKEAVRAFFLEHVNKNT VFFYSLEEKISYLIREGYIDK TVITDKYSMEFIKKLFKFYS KKFRFDTFMGAYRFYKQYA MKTDDGERYLERYEDRVAF NALTMGDGDEELAMKIADE LINRRYQPATPTFLNAGRLR RGEYVSCFLIQVEDSMSSIG RTLNSALQLSKLGGGVGINL SNLRALGDPIKGIEGAGSGV VPVMKMLEDGFRYANQLG QRQGAGAVYLNVFHADIM (SEQ ID NO: 160) | 716 | putative ribonucleotide reductase [Enterococcus phage phiEF24C] | YP_001504318.1 | 0,0 (710/716) | ribonucleotide reductase | Ribonucleotide reductase, classI | cd01679 | 1e-132 |

FIG. 5F

| | | | | | | | | |
|---|---|---|---|---|---|---|---|---|
| 31 | 13783 | 13541 | MTKVTVYSKDMCGQCLFLK NMLNGKNIPFDEKNISHDEQ ALAYLKEKGVSSLPYYEADD GFSFNGVRPDLVKKLEKEL GV (SEQ ID NO: 161) | 80 | putative ribonucleotide reductase [Enterococcus phage phiEF24C] | YP_001504319.1 | 9e-40 (80/80) | ribonucleotide reductase | NrdH-redoxin (NrdH) family | cd02976 | 8e-12 |
| 32 | 14176 | 13910 | LATRNKIGTYTNDEGNVVVQ MAGSKAELLELLSFLNAKYL LEVTDTPEEYQKVFNRLQV ETGKNYSVLLLDKVTNKSQE SEDFLGDKV (SEQ ID NO: 162) | 89 | hypothetical protein EFP_gp211 [Enterococcus phage phiEF24C] | YP_001504320.1 | 3e-41 (84/86) | | No putative conserved domains have been detected | | |
| 33 | 14487 | 14182 | MKITDLQKKELLEKDLRSYK KLYELQKSIKEEIEDELKSSIIS DMEELGESKISIDGGTFKLM PEYKRASADTKLLMNVYPN VWEEKVKNVYTVNKYIKFTKD (SEQ ID NO: 163) | 101 | hypothetical protein EFP_gp212 [Enterococcus phage phiEF24C] | YP_001504321.1 | 2e-49 (100/101) | | No putative conserved domains have been detected | | |
| 34 | 14808 | 14578 | MEEKVFKPKVLKRVREARG ESLRELANMIGVHWSSISY WENGIKEPRVKNRVKLAKL YNIPVEILFEEDNGQELPL (SEQ ID NO: 164) | 76 | putative transcriptional regulator [Enterococcus phage phiEF24C] | YP_001504322.1 | 4e-34 (74/76) | transcriptional regulator | Helix-turn-helix XRE-family like proteins | cd00093 | 3e-06 |
| 35 | 15096 | 14872 | MKKFYGIISTTTRTEEYEKK LKNGKTEIRTREVTVPKEITV QSSQPDRLGARKELEAFAR KCNGKVTYIGAFA (SEQ ID NO: 165) | 74 | hypothetical protein EFP_gp214 [Enterococcus phage phiEF24C] | YP_001504323.1 | 6e-35 (74/74) | | No putative conserved domains have been detected | | |
| 36 | 15491 | 15207 | MILQILGERKYDCKDSTEEPI VKPFIELIDGVQFILLEQENAF SLLNSKHEEITRVPNSFYEY RTEKEGYKTFVNSYYVLND EGKTLRRLFERGL (SEQ ID NO: 166) | 94 | No significant similarity found. | | | | No putative conserved domains have been detected | | |
| 37 | 16814 | 15543 | GCUGAUUUAGUAUAAUGG CUAUUACUCCGGAAUGGGAGUUC ACCCGGGAAUGGGAGUUC GACUCUCUCAAUCAGCA (SEQ ID NO: 167) | | | | | tRNA6-Thr | | | |

FIG. 5G

| | | | | | | | | |
|---|---|---|---|---|---|---|---|---|
| 38 | 16731 | 15640 | MKVINYGSNYEIYANDLKTY DKLPAQTYKVRFNPMSGFS LAVTDDFKLKESKVYGDRLV KIEKVLHTFKTINRSLGVILS GDKGIGKSLFTQILSQRAIEE GMPVILITEAYPGIAEFIDSID QESLILFDEFEKVNDRDGR ESQEKLLSLFDGLSQRKRY ALTVNNLNRVNDFMLNRPG RFHYHLRFDYPDADEIRTYL QDKLDKAYYGEIDSVVKFSR RIKLNYDCLRAIALELSFGIS FGEAIADLNILN (SEQ ID NO: 168) | 363 | hypothetical protein EFP_gp215 [Enterococcus phage phiEF24C] | YP_001504324.1 | 0,0 (360/363) | ATPase | AAA+ (ATPases associated with a wide variety of cellular activities) superfamily | cd00009 | 3e-04 |
| 39 | 17175 | 17102 | GGACGUUUAGCUCAGUUG GUcAGAGCAUUCGGCUCA UAACCGAACGGUCCGAGG UUCGAGACCUGCAAUGUC CA (SEQ ID NO: 169) | | | | | tRNA5-Met | | |
| 40 | 17307 | 17234 | CGGAAAGUAGCUCAGCCUU GGUAGAGUGCAGGCUUUG GGAGUCUGAUGUCGCAGG UUCAAGUGCUGUCUUUCC GA (SEQ ID NO: 170) | | | | | tRNA4-Pro | | |
| 41 | 18179 | 18106 | GUAGGUGUAGCUCAAUCG GAUAGAGCAUCCGCCUUC UAAGGGACGGUUGGGG GUUCGAAUCCCGCCAUGU ACG (SEQ ID NO: 171) | | | | | tRNA3-Arg | | |
| 42 | 18736 | 18665 | AGUCGGUUAGUGUAACUG GUAACACGUUGGUCUCCA AAACCAAUAUAUAGGGGUU CAAAUCCUCUAGCGAUUG (SEQ ID NO: 172) | | | | | tRNA2-Trp | | |
| 43 | 19063 | 18991 | GGCAGUAUAGGGCAGAGG UUGUCCCAACACGUUGGC AGGCUGGAACACACGGGU UCGAGUCCCGUUACUGUC G (SEQ ID NO: 173) | | | | | tRNA1-Asp | | |

FIG. 5H

| | | Sequence | | Description | Accession | E-value (Id/len) | | |
|---|---|---|---|---|---|---|---|---|
| 44 | 20860 | MNYPKREKVVEVSLTSGTY SVFPRRLGVTTNDAMSIVN GAMKGAELPMIPVHKLADR DSELTYVNAFQIQTATENVV DVPERITSLYTKPEDETPED EEIRLGTINNYFSLR (SEQ ID NO: 174) | 112 | structural protein [Enterococcus phage phiEF24C] | YP_001504328.1 | 4e-51 (109/112) | structural protein | No putative conserved domains have been detected |
| 45 | 21286 | MNDYQVNDLVLRLQRLEDK LQHGELTEKGIIKQDNVELNS AVSELRDIVNSLDKRLAVHE EKYAHLTYQITKLEETIDALE GVNDKEFDHKRDIVENVFMI VLGAVVTYVFSMFK (SEQ ID NO: 175) | 114 | hypothetical protein EFP_gp220 [Enterococcus phage phiEF24C] | YP_001504329.1 | 9e-59 (114/114) | | PHA02414, hypothetical protein / PHA02414 1e-39 |
| 46 | 21583 | MYETALVCVLLLQMFVYLM SYYVTRALQYKKLQAELSPL ASYKFTFVLYGISIGSLYLFF NGYYIPIVTVGAIIGILVCLW FTSD (SEQ ID NO: 176) | 86 | hypothetical protein EFP_gp221 [Enterococcus phage phiEF24C] | YP_001504330.1 | 3e-41 (86/86) | | No putative conserved domains have been detected |
| 47 | 21700 | MDNSKRIIKKIIFITISALVMVT LSKLFSKYVIVEQNAPFQALI GGASCALLSSILFDWYTNKK KKENVENQLKEAISDLQKIK AIIKR (SEQ ID NO: 177) | 89 | hypothetical protein EFP_gp001 [Enterococcus phage phiEF24C] | YP_001504110.1 | 5e-43 (89/89) | | No putative conserved domains have been detected |
| 48 | 21990 | VSITNKDIKDKRRYIFSQSSK TTTIKRGDKRISSATRICAVC GRPLSKLVLRTGVPTVVVD HISGKISDIVRLNVCEDIRSC YAYSSKKGES (SEQ ID NO: 178) | 92 | hypothetical protein EFP_gp002 [Enterococcus phage phiEF24C] | YP_001504111.1 | 3e-44 (91/92) | | No putative conserved domains have been detected |
| 49 | 22272 | MGMADRLKDNAKQKKLERT PEQQLRDTFNQASIKLINQF MANVTSGAIEVDDIADLTRL FQIYLQVNNINDGMQEGTG TLPALTSEHKDIISEKVSTEKI IKDGEEEELISLDELASLPDD QLEEVLVNRELQMNRENEA TF (SEQ ID NO: 179) | 142 | hypothetical protein EFP_gp003 [Enterococcus phage phiEF24C] | YP_001504112.1 | 2e-74 (140/140) | | No putative conserved domains have been detected |

FIG. 5I

| | | | | | | | |
|---|---|---|---|---|---|---|---|
| 50 | 227700 | 24535 | MTTKAQHIAKMAKEMYGTD KITTEGLAYITDMLTPSTYLL RNHSVRNHPITFIISGRDATK AQAHRPWQPKIINDQHRDK AIIKSRQLGLSEMGVGSMLQ FADTHSYDAVKGLYTFPTNE QMTKFVQTRLDPVLQNGYY STIVDQEVNSLKAKKIRNSFL YFRSSSKPGAVEGVDIDYLS MDEYDRVPALAEASALESM SSSPYKVVNRWSTPSAPDM GIHGLFKGSDQHWYLHKCE KCNYYNEMSYDAYTPEAP (SEQ ID NO: 180) | 611 | putative large terminase [Enterococcus phage phiEF24C] | YP_001504114.1 | 0.0 (494/494) | large terminase | Phage terminase large subunit (GpA) | pfam05876 | 1e-09 |
| 51 | 246635 | 25423 | MVDNNVKISKSTIEGLINKSL SYEYVIKNNELLTNEYQHIVK AYGFDNFYDMYLYADSCDS KDMYLVKGGQKDLSKLKPV KRKVVRNGKTMTTIYEDTG SSDNNNSNPLDKESKKKKE LEPVNAKELRKVSLGSDEEE KLDPKKIAKLLADTKKFGNN FDTQCTDYLILEQDSVTRGV VGFTREGSYLKMGFSMSDE AVEGMKMLAFSQLTLKAWK LGLGAKISTDNAPDVEELISL YGYKRNKTEYIVSMSSL (SEQ ID NO: 181) | 262 | hypothetical protein EFP_gp006 [Enterococcus phage phiEF24C] | YP_001504115.1 | 2e-148 (261/262) | | No putative conserved domains have been detected | |
| 52 | 26612 | 26244 | MELIMNNKKLDELTNKVATD EDYDIFVEKMGNLVKDLYEN YQFLQQNPPEGDYTSGYFL GFQVIRAEYPEYENLFRLA VDKNLNELEINKRIFVEAVKD GKVLPLGEAVIDELQTGCSS ILQAQEVRVNIVFGTKEYMA KQEEERKERQAKLEEERER AMEVLKTKDDVLNTLRVTEA LANELTDEVAEKYDLMELVN SMREGLKAHNGN (SEQ ID NO: 182) | 210 | hypothetical protein EFP_gp007 [Enterococcus phage phiEF24C] | YP_001504116.1 | 6e-116 (209/210) | | No putative conserved domains have been detected | |

FIG. 5J

| | | | | | | |
|---|---|---|---|---|---|---|
| 53 | 26234 | 26578 | MEIKNSLGKALIKNLRLLKEK RDAMPDNLEYTSQVMIPVP YYLIKKGDNAVESFLMCAG MINRNKDLGLPISLEKQKQQ VKLNNGELTTIVECVATYSD KTDIDGVERFLVEHL (SEQ ID NO: 183) | 114 | hypothetical protein EFP_gp008 [Enterococcus phage phiEF24C] | YP_001504117.1 | 1e-59 (113/114) | | No putative conserved domains have been detected |
| 54 | 26672 | 27641 | MAGEVFSSLITSVNPNPMN AGSRNGTITIDTIILHHNATTN KDVAMNTWLLGGGAGTSA HYECTPTEIIGCVGEQYSAF HAGGTGGIDVPKIANPNQR SIGIENVNSSGAPNWSVDP RTITNCARLVADICTRYGIPC DRQHVLGHNEVTATACPGG MDVDEVVRQAQQFMAGGS NNAVKPEPSKPTPSKPSNN KNKEGVATMYCLYERPINSK TGVLEWNGDAWTVMFCNG VNCRRVSHPDEMKVIEDIYR KNNG (SEQ ID NO: 184) | 289 | putative N-acetylmuramoyl-L-alanine amidase [Enterococcus phage phiEF24C] | YP_001504118.1 | 3e-169 (268/289) | amidase endolysin | Amidase_2, N-acetylmura-moyl-L-alanine amidase | pfam01510, 3e-10 |
| 55 | 27708 | 28346 | LKKTSILGLSLLSLGLVVGLG TEAKAEEVTENGKTYWKVE SGDTLSEIGAKYNLDFTNIH KVNKGVVADPNVIFVGDKFL PLDENGKLVEQVNTTEPDI EVQYNAPVTPEQPVVVEQE VVEQPVVVAETPAPVVEAP ADSSSAKEWIAQRESSGSY DATNGQYIGRYQLSASYLN GDYSPANQERVADEYVAGR YGSWENAKSPWLANGWY (SEQ ID NO: 185) | 212 | peptidoglycan-binding LysM [Enterococcus phage phiEF24C] | YP_001504119.1 | 2e-92 (206/212) | LysM domain-containing protein | LysM, lysin domain | cd00118, 7e-05 |

FIG. 5K

| | | | | | | | |
|---|---|---|---|---|---|---|---|
| 56 | 28498 | 28832 | MGYIQDETWQMVKKVAKKN GFVGDWLIIHSYYEYGGNH VQIHTTINGESYRILRLLDSR EILLLDRKGNPVIYDYEIVND GQKSFFYNDMEEKEIEIPNG RCLNDKTRVKIYV (SEQ ID NO: 186) | hypothetical protein EFP_gp011 [Enterococcus phage phiEF24C] | 114 | YP_001504120.1 | 2e-60 (113/114) | | No putative conserved domains have been detected |
| 57 | 28847 | 30568 | LPKWLDKALGIEKSSIEETR NMENYKMHLREIDTNVVNN EPYSMESIEKGMNGKTAY MQPIIGEMSVNPGYKTKPSI RNSQDLHKTLKKFGNNIILN AIINTRSNQVSMYCKPARNS ETGVGYEIRLKDIEAEPTSH DIANIKRIESFLENTAQFRDP NRDNFTTFCKKLVRATYMY DQVNFEKVFDKDGNFIKFDT VDPTTIFLATNGEGKLIKNGE RFVGQVIDNRIVAKFNERELA FAVRNPRADIEVGQYG (SEQ ID NO: 187) | putative portal protein [Enterococcus phage phiEF24C] | 573 | YP_001504121.1 | 0.0 (571/573) | portal protein | Phage portal protein | pfam04860 | 1e-05 |
| 58 | 30679 | 31470 | LSEVREKYSIFVPLDIENSIQ KSESVNDGEMVVQGYATTP DLDLQGDIILPQGIDISYFIEN GWMNYEHKNDAEFIIGAPTS NCYYVDVDKGLFVEAKLLKD NKRYAQSMWKLANTIQKSGIS RQLGFSIEGAVVSRNAQDN RIIEGVKIHNVALTTHPANPR ATWETLVKSWTTGYGTAPD AQVDAGALRREMFKEDISN LTYAVRTIAGLYSKKPAEKE FILREVAKDIEVDTSENELSK FMLQLSRGISLKEAT (SEQ ID NO: 188) | putative prohead protease [Enterococcus phage phiEF24C] | 263 | YP_001504123.1 | 9e-152 (260/263) | prohead protease | Peptidase_ U35 | pfam04586 | 3e-07 |

FIG. 5L

| | | | | | |
|---|---|---|---|---|---|
| 59 | 31477 | 32430 | VAKTLNDIIEDFDAGLNEKVK PTTDEETKSVEEPTEPEKV EEGAEVEQEEKPNESEETA GNDGEESGVTETVEAEQEE PETVEEVVVEEPVEESAEETV EKSDKTKENKDEEEEEDEE DEDKKKEKDKKDKKDKKDKE DKEDIEKSTEVEQVIKSSEIL GAMEAIFKNMLGLSEKLDEI HREFKEAKEAKEAKDEA ESVEKSLLDNPEIKTGKEDS EGKAVGFVNKSVAVEEEVA TEEPTVDVVVDGEQDTAEP (SEQ ID NO: 189) | hypothetical protein EFP_gp015 [Enterococcus phage phiEF24C] | YP_001504124.1 | 1e-116 (290/317) | No putative conserved domains have been detected |
| 60 | 32571 | 33971 | MTEKKNTERQLTSVQEEVIK GFTTGYGITPESQTDAAALR REFLDDQITMLTWADGDLS FYRDITKRPATSTVAKYDVY LAHGRVGHTRFTREIGVAPI SDPNLRQKTVNMKYVSDTK NMSIATGLVNIEDPMRILTD DAISVVAKTEWASFYGDSD LSENPDAGSGLEFDGLAKLI DKIHNVLDAKGASLTEALLN QASVLVGKGYGTPTDAYMP IGVQADFVNQQLDRQVQVIS DNGQNATMGRNVKGFNSA (SEQ ID NO: 190) | putative major capsid protein [Enterococcus phage phiEF24C] | YP_001504125.1 | 0.0 (462/464) | major capsid protein |
| 61 | 34070 | 34333 | MLKSEILINKTVTTAFGEVTF DHNGETTDLTVEQQEHLGT KVPYIQYIPDAPKAKEKEAT AEKADEAPKKAKKAPAKKTT KSKKEED (SEQ ID NO: 191) | hypothetical protein EFP_gp017 [Enterococcus phage phiEF24C] | YP_001504126.1 | 2e-41 (87/87) | No putative conserved domains have been detected |

FIG. 5M

| | | | | | | |
|---|---|---|---|---|---|---|
| 62 | 34346 | MYPDYGYEEQGDNTYQYQ PYAHGNPKHIDLDKIDDIQP ADYGWTPATLKQYMFGVEV VNPETGEPLGDTFYEHIDS AIAKAEKRLDIAIMPRLIRGE HHDYHQSDFNSYMYTHVFK RPIIQAEKLQLEVNGRGLYR YFSNWWKYALAGHIQMYP TSLMQTGTQFGYEMTFSGY PQLAGMPPSGGQVDAPQMI HIDYVAGMLPRKNRGYNED WECFADLEQLVIKYALKEIF QQWGRLIIGAGIASKSLTVD GI (SEQ ID NO: 192) | 35245 | hypothetical protein EFP_gp018 [Enterococcus phage phiEF24C] | YP_001504127.1 | 4e-176 (299/299) | No putative conserved domains have been detected |
| 63 | 35262 | MGEKPIRFGGAGETGNPNIK QLNTSRVEFETKGMASFIEN RGIDVLWERAWLCTCRNPM TLSPKSDCPICRGRGIAYQP AVKLRMAIQSQEKGISNQDL GILDTGTAIGTTTELDSKITFR DRITVPEVKIYQSFIFNVNKR RVANGLFLSYDVNSIEDIYG KDGRILVDGVDFRMDYDTN TIYPNESLIDTNISINMSVTLR YIVIDLLKESRYQYTTFGVKQ TQFESLPKKLLLKREDVFIDS EPFSLDIDTASR (SEQ ID NO: 193) | 36131 | hypothetical protein EFP_gp019 [Enterococcus phage phiEF24C] | YP_001504128.1 | 4e-167 (288/289) | No putative conserved domains have been detected |
| 64 | 36124 | MARKGQRPVLFTDSKAILG NLTRAVVDEVLSDAQDVAL RNGSSVQRMPSYLIVTESR MAKNGVIDLKPFFARSNKKK YNKKGEWYLYIPISMKTRNM SRRLYDELRAVRVGTKPVT VKMDYLYDRRKQSPSVSSI NYKPKSTNVTVIPQSWGKG TRNTYVAFRTVNANSPANS WIINRRNVNDDMSKTMLR NIDRLMKWKLKNLGG (SEQ ID NO: 194) | 36747 | hypothetical protein EFP_gp020 [Enterococcus phage phiEF24C] | YP_001504129.1 | 5e-116 (207/207) | No putative conserved domains have been detected |

FIG. 5N

| | | | | | | |
|---|---|---|---|---|---|---|
| 65 | 36751 | 37598 | MIPSLDTYLYKEFEERLRIILS ECYIIDEALKGMDKEALESF KNTYCSIDGKPPKREVEMS YSFFQEHLDSFARFVVTLGS SEEDSKSIGGIQGGYEYRE GNVISEEATIIREGDKLIINTS KPVADYLNSSDISFAESDHF RIEDNKPVFDFSYNEELEGI SINVSYISKVSDDDVAGVYK GYQSNDNVSIIGISSNIDTAR CLDAIARIILITIMRDSLDEKTG YMLQITLHFGDMQVVIESGE TLVFGRPCTVN (SEQ ID NO: 195) | 281 | hypothetical protein EFP_gp021 [Enterococcus phage phiEF24C] | YP_001504130.1 | 3e-161 (281/281) | | No putative conserved domains have been detected |
| 66 | 37598 | 37829 | VAKETEKVVKKEVKKEQPK KPKGYVHVDTFLDYAKVLY GLNKYQVAGFRALMAGREY QHEDADFVPFLEKYIGKEVK (SEQ ID NO: 196) | 77 | hypothetical protein EFP_gp022 [Enterococcus phage phiEF24C] | YP_001504131.1 | 1e-35 (76/77) | | No putative conserved domains have been detected |
| 67 | 37833 | 39542 | MAVEQFPRKKVSRFHTEITV DTSGIGGASSSSDKTLMLV GSAKGGKPDTVYRFRNYQ QAKQVLRSGDLLDAIELAW NASDVNTASAGDILAVRED AKNATLTKGGLLTFASTYGV DANEIQVALEDNNLTHTKRL TVAFSKDGYKKVFDNLGKIF SIQYKGSEAQANFTIAQDKIS KKATTLTLNVGAEPESTTEV MKYELGQGVYSETNVLVSAI NSLPDWEAKFFIGDKNLPT DALEAVTKVDVKTEAVFV (SEQ ID NO: 197) | 569 | putative tail sheath protein [Enterococcus phage phiEF24C] | YP_001504132.1 | 0.0 (568/569) | tail sheath protein | No putative conserved domains have been detected |
| 68 | 39603 | 40025 | MASVGNQTVHTGNTVYLMI GNKIIGRAQSASGERQYGT QGIYEIGSIMPQEHVYLKYE GTITLERMRMKKEDLASLGI TALGEDILQRDIIDIVMMDNL TKEIVVAYRGCSAISYSESFT ANEVTSESTQFTYLTSAKVK (SEQ ID NO: 198) | 140 | structural protein [Enterococcus phage phiEF24C] | YP_001504133.1 | 5e-76 (140/140) | structural protein | No putative conserved domains have been detected |

FIG. 50

| 69 | 40117 | 40263 | VKYPYLVELYAKHVIRDSGYI ENVPPVIYEDVVKRVEEIKR EENLTID (SEQ ID NO: 199) | hypothetical protein EFP_gp026 [Enterococcus phage phiEF24C] | 48 | YP_001504135.1 | 7e-18 (47/48) | | No putative conserved domains have been detected | |
|---|---|---|---|---|---|---|---|---|---|---|
| 70 | 40399 | 40872 | MTENNEKVFTPTPNLSREQ LIEKLQRGENLTDEEVNILKY YNDAEERKQLDRIIPGVNDV FSKHYNLKEYGLEFDIKIKAP NIIENGKIQARREAYLEGMG MAVSNFIFQSYQMLATIRVC GVEVPEVLADDEKIYNLYVL GVIAKDYGEWLNSFRY (SEQ ID NO: 200) | hypothetical protein EFP_gp027 [Enterococcus phage phiEF24C] | 157 | YP_001504136.1 | 9e-87 (157/157) | | No putative conserved domains have been detected | |
| 71 | 40940 | 41515 | MKKFKVLPSDPAWQNLTSD QVEWILYNMERDIEEQERLA KGMQLESEFQDYDDSWYD KPHDEFSPIREGDDEEIAR KLSEITSEEDMAKLKARWEA SQEVDAIRAEGGTTIEEDTIN ELIANNVKKAMEEARRIEKH GGNKWQEKSSIELEEERKN LEFNSQLKQGDIQEAIDLFN KDVEPTSLDDEFQI (SEQ ID NO: 201) | putative RNA polymerase [Enterococcus phage phiEF24C] | 191 | YP_001504137.1 | 6e-105 (190/191) | RNA polymerase | RPO41, Mitochondri al DNA-directed RNA polymerase | COG5108 | 0.010 |
| 72 | 41560 | 45216 | MSNNYRFYVEAMTGDAVAK LNEIDKLMDKIDSKSAKGTQ NFFHTSQKDIDKAVEEMQKL IKAKKELDRAFDNQKINAES MGDMTAYKRAVSDAEELTR RFNKTQKEFQNHARMQAN PNYINASTLRQQKAFRDELT EQERAIRNISRAQQELNRVN SRVNHRANQASATGRMTY NQSESMKRDLRRTGVFESL GSENKSRQQELRERYKQR QEELAETRSNTNLDRQVRK NRETSIQAEIKEIEKEIEARK RLAD (SEQ ID NO: 202) | putative tail lysin [Enterococcus phage phiEF24C] | 1218 | YP_001504138.1 | 0.0 (1201/1218) | tail lysin | SLT domain proteins | COG3953 | 1e-08 |

FIG. 5P

| | | | | | | | |
|---|---|---|---|---|---|---|---|
| 73 | 45255 | MSVELRYPRFDLTF-TETDN YHIVYDAKDGLTGRNNNG ETEKVSNNFMAESVISLTTK NALEDDSAVFSFVLAGDVY WDRVLNANDAVILKIDPDTS STKKSDNPVLLVGLISEVRL EGDYGENSKMYRITGQSFA KALMQFDLGVIQEVSVVLTD LGWLPDDAQEGIKMSGS3A SQIAESLMKRFLQYMKFNFN GQGIDKFLEWELDSWTEAE RLIDSTPYINYEGSLKQLJDD VTAKPFNELYFDATPEGKG (SEQ ID NO: 203) | 48440 | 1061 | putative tail lysin [Enterococcus phage phiEF24C] | YP_001504139.1 | 0,0 (1058/1061) | tail lysin | NlpC/P60 family (function unknown, found in several lipoproteins) | pfam00877 | 8e-06 |
| 74 | 48534 | LVKRRFCAGLGSEIKRVYKE GQQINTLLAQVICVNYKYN TVDLLALQHKEVFQNSYAN EGRFSARLPMEFGGRNIVG QPYGQVNPIAVGTVVLVGFI NSDKDMPIVISVYNNDVSK QLSRTQFSNSDPKDELIGD MHQKFSLYPSLTYDSVDGE GGRVVTFSGKGFIAFDTKEV ANSSTTDAGYGTKYEDLET SYYNNGDLIEPMKGRAPNV LFKHQGVLDDDGKPDLHDL LIHINPDGTYRTSMMNKEED W (SEQ ID NO: 204) | 54002 | 1822 | putative tail fiber [Enterococcus phage phiEF24C] | YP_001504140.1 | 0,0 (1820/1822) | tail fiber | No putative conserved domains have been detected |
| 75 | 54102 | MALNGTKYTAFARHRLVLE VRANQNIAGNYSTISVVLYL QSMDKWGRLDAPAIGDAKV TVDGTTQTEKASSMLNAFQ KKLLAKEVRVNHNNDGSK RITIGGSYFVNVTFTDNGVP TYYGTITIPNFSVDLNRIPRR SSLNPVPTLNLPGNLPITINR QSSTFKHNLTAWWANRDNP TLNNDDHWTYLTNLNDVGT SGAFSFTVANNKTIFTALNN RTSWQGKVKLVTIGLDDVV SQERTYKIVPPMNAQASGG K (SEQ ID NO: 205) | 56513 | 803 | putative minor structural protein [Enterococcus phage phiEF24C] | YP_001504141.1 | 0,0 (769/810) | minor structural protein | No putative conserved domains have been detected |

FIG. 5Q

| | | | | | | |
|---|---|---|---|---|---|---|
| 76 | 56507 | MVEETQKIFVTLDDKDFVSN WGTSLNSDEPYYEVDLPMD SPFFSHYYSNCFQYVDGEL VLSEEKLLKVELLAVASKFK RDCEETYILQKVPYTISGTTY LFDVISDDEFINKITLLDNKIQ DYYGITAYATSDGSQLILKF DKSQYTTMTRYIKKVESRE NKLNNKLLPMIENAKSVEEA KEISWSSVPDELLPEQESNE PQDEQSIDSLIKENKELRQK VEFNELALMDAINMFSEMN K (SEQ ID NO: 206) | 241 | hypothetical protein EFP_gp033 [Enterococcus phage phiEF24C] | YP_001504142.1 | 4e-134 (237/241) | No putative conserved domains have been detected |
| 77 | 57264 | MYPYLSMLYASYVIKDPENY PLEKVPALIREDVEKIVEEMA KKNEKQG (SEQ ID NO: 207) | 48 | hypothetical protein EFP_gp034 [Enterococcus phage phiEF24C] | YP_001504143.1 | 9e-19 (48/48) | No putative conserved domains have been detected |
| 78 | 57547 | MGQSDGMGGTLKRIAIQVG NDPNKGWYRFQVNPTQYK YNKPHRVTIFKTKSNIITEDF GKDIETIQFSGTTGFRVDSR GKNGADRLKELEEIIDNYAK QGGGNGNRSSVEMKFYNFT DDKYFVVHLAPEGLSIERSA EQPLLFNYTLSLVVLREAGQ PSERAQVSPQIGNVSPSIGR TYNAQQDTRTPAQILHDEY RRSVMPNTAVNPAVTSGAY NYGVNELKKIIGYGG (SEQ ID NO: 208) | 229 | hypothetical protein EFP_gp035 [Enterococcus phage phiEF24C] | YP_001504144.1 | 3e-130 (226/229) | No putative conserved domains have been detected |
| 79 | 58240 | MEKVEQSADLLRFFRYLNV DINGEVVANWDDQPNFISR FYTPHTRVNKISSTLLDIVRD NDIGETNKALSKDSLTYKFL KSGLKLSSPRIYELAQIVVLE SFALIIYAIEEEPEMFKMINES DVKQTRENVKYLIDCLGGAK DYTDIVMDLQSMDVALGYIQ EQVPLIQGGLPVNGTI (SEQ ID NO: 209) | 178 | hypothetical protein EFP_gp036 [Enterococcus phage phiEF24C] | YP_001504145.1 | 6e-99 (178/178) | No putative conserved domains have been detected |

FIG. 5R

| | | | | | | |
|---|---|---|---|---|---|---|
| 80 | 58763 | MARYKKHLIVYGDTMQSIAQ KETGSSVDNWVKIAEYNDLV YPYIVDTMQEKMSNLEHLAT LGDTLFIPDEGNLLDNTSSL NQRDMDFLLGLALGKDLDM TSDTDYYENHGTSDEVFAIT HNGHGDLKIASGADNIKQAT ISRLMTAKGSLMLHPEYGSD LHLMFGKTTIEQMKISIEVC DTVLKDTRVAECVLVNHYIE EDRYVGNYRATLQSTREQF EFVVQNDMSGALJIV (SEQ ID NO: 210) | 234 | putative baseplate protein [Enterococcus phage phiEF24C] | YP_001504146.1 | 8e-135 (233/234) | baseplate protein | No putative conserved domains have been detected |
| 81 | 59483 | MRLKKISEILGRLIDVTMINT HEINDFSVGSTIRSIYEAVSM ELEQYYILGRENILWGIEQG VLNAFDFRKREAKRAYGMV TLEFHTVTQTPVVVPTGTTF DSSLSGAPSTLTFQTMQDYI IPEGVITAKVEVYCTTVGTK GNIPKGRINRVVINNISNLKTV YNEFDFLTGTDEESIESVKK RFHAFVESRGRATIKALDYG TRQVEEVAGVVIKEEVGYV RIYAHIDLNGDLKQETLDKIK VAIEDYRPAGIKLD (SEQ ID NO: 211) | 18 | putative structural protein [Enterococcus phage phiEF24C] | YP_001504147.1 | 0.0 (348/350) | structural protein | |
| 82 | 60553 | VSNFYKNIHPLLRRGKKPNK YDDTNFAVLNALNYELTQAE QETIASKIHSSLETATGEYLD TWGDWFGVVYRKDDWNDEY YRKRIIRELLLKRATIPAIIDAL LDFLNDNDAVIQIYEPWRNIF YTNKSSKLNGDDHLMGYYYR FAIIDISIDRPFPPEIVEIIKAPK PAGVLFYLRLDTSLNKNKTT VESPYVVLDVTNKTELEFLN GLYYDLRGNINLSDQRTQV VESNIFHTNNSMLNGEDVLA GAFDHGRGYI (SEQ ID NO: 212) | 805 | hypothetical protein EFP_gp039 [Enterococcus phage phiEF24C] | YP_001504148.1 | 2e-132 (228/305) | | XkdT, uncharacterized homolog of phage Mu protein gp47 COG3299 2e-05 |
| | | | | | | | No putative conserved domains have been detected |

FIG. 5S

| | | | | | | |
|---|---|---|---|---|---|---|
| 83 | 63076 | VAIATNNSRVYASLQLKNKQ DSMYLAIGKTTPWTNEDAP PAPDPNTTLTEVIGYKKVA RVSLQREYLPSDDSKYPVV SYGSRKFTLIPDEDGYKEQA VMVYVEAEITGDELPTGTF RQVGIHTDLVSKASSEKKAL LPTDVTDAGILQFFENRQQQ NRTSDVILKEKFHTMENKKS VKQ (SEQ ID NO: 213) | 181 | structural protein [Enterococcus phage phiEF24C] | YP_001504149.1 | 1e-101 (179/181) | structural protein | No putative conserved domains have been detected |
| 84 | 63636 | MAKNITNDDLGKEPYNNRY YQGKRFSGLLFKPDKPLQQ AELNELQSIIQGDLGNVAESI FSDGDIQTGMEYVLQDKKL TIKKGKVFLGGKMRNFDEQ SIDITGEGTEYVGVKLVQKVI TAEDDPSLLDQTSGVPSHF SEGADRLDEDVLAVNDDS ASNIYHFVNGELYINPDTPE MDKINKILAERTYDESGSYR VRGFDMYTEVHPTDPNNKI QLVVDSGRAYVLGFKVDKP TTTRIDIEKSRELETINNEGF (SEQ ID NO: 214) | 1164 | putative adsorption associated tail protein [Enterococcus phage phiEF24C] | YP_001504150.1 | 0.0 (1152/1154) | adsorption associated tail protein | |
| 85 | 67198 | MQKFKDLTGQTFGKWTVVD IDETKDRIHWNCECECGKE QSIRASSLTSGNSKGCREC TRNNLMGKTFGRLAVIKDS GERAKNGNILMECVCDCGK KRLVLGANLLNGQTKSCGC YSTDILKKVSTKHGLSKVNG KKTKLFMTWDAMRQRCTN SNHASYKDYGGRGITVCPE WLNNFKSFYDWSMDNGFS NDLSIDRIDNDKGYSPDNCR WVDAKTQIRNRRNTVTYNW KGSEYTLAELGELTGINKMTI KSRLNR (SEQ ID NO: 215) | 317 | conserved hypothetical protein [Bacillus cereus G9241] | ZP_002241204.1 | 3e-37 (82/195) | | No putative conserved domains have been detected |
| | 67100 | | | hypothetical protein 39-O_gp07 [Clostridium phage 39-O] | YP_002265415.1 | 1e-35 (84/209) | | |
| 86 | 68231 | LPETHRQTSSGALIFKPTIAE QEHKNAMESIKQERTELEK ELANVKAIKDELSKELADIKQ LKDELSK (SEQ ID NO: 216) | 68 | hypothetical protein EFP_gp042 [Enterococcus phage phiEF24C] | YP_001504151.1 | 6e-30 (67/68) | | No putative conserved domains have been detected |

FIG. 5T

| | | | | | | | |
|---|---|---|---|---|---|---|---|
| 87 | 68692 | MRLVVDIMHTQIRYEDSENY LRPEIHKVMHSSELGVKADG YQFSPAYKAGYWDGIIDFFD KENDTFPTGLLPHVETILQN LQSTLSKSGYIFQFEIIDDRP DEFMSVEDMDKEIVLNGDN NDKITLRDYQYESVEQVIKN RIGIVNVSTGGGKTEIASGLI QQITPYLE3GERIAFFTNSS SIFSQSIDRIEKRLGIKVGAF GAGKKDIQQVTFVMIPTIVS AISADPEAKLKLTAKERMYK KIAKDIAPKFERGF (SEQ ID NO: 217) | 590 | putative helicase [Enterococcus phage phiEF24C] | YP_001504152.1 | 0.0 (588/590) | helicase | HELICc, helicase superfamily c-terminal domain | cd00079 | 2e-11 |
| 88 | 70492 70464 | LQSPGLNIELKEKFKLNKGIT DFLERVADKSQRWGETVAS PIRKTDMAKETGKNPRTITR YINQLEELGLIKTETKRGMN GGTLVVFNTDMLNFEPKEN PITSDTKGAKEIREQVFPKA PTKVPKRRYRTKAEIAEARIL SEKLKKREDILNDKIEFNVVT RSFFDSFDEPEVYFKGYLIS RMYNAYVTIIPYEKYNRLKN LDEKKAKQQLRAYESSYNY DVLPRRFVGTPQYKFVEL AKYCEENNINPLVYLT (SEQ ID NO: 218) | 542 | putative transcriptional regulator [Enterococcus phage phiEF24C] | YP_001504153.1 | 0.0 (539/542) | transcriptional regulator | HTH_CRP, helix_turn _helix, cAMP regulatory protein C-terminus | cd00092 | 0.003 |
| 89 | 72153 73625 | MSQIQKQVMYRALSEPFFAK EILSKIPMDEFKDSGYEMIVS TINLYYRTHDESLEEQSLLTL VEDKMLKQNKSLEAQNKVF EVVSDLYELENEDVDSEVIS ENIQNYVRKVLTREAIMKSV TNEGTLGSDSNIQLQLMDDL RDILTIETAGNNSELLDFFDD VDKKMELLANLQQNKYPTG FTAIDAISDGGLARGEVGMV VAPTGGGKTTWAVNQARN YVVRGLNVLYVPLEEKVDR MIVRFEQLLSQQSKKNIL (SEQ ID NO: 219) | 490 | putative helicase [Enterococcus phage phiEF24C] | YP_001504154.1 | 0.0 (490/490) | helicase | DnaB_C, DnaB helicase C terminal domain | cd00084 | 6e-13 |

FIG. 5U

| | | | | | | | |
|---|---|---|---|---|---|---|---|
| 90 | 73625 | MKHINFSDFHMHFFKDFSK PDPEYGTDRAKEQITILDNL MNYARNKNGDVLFNGDMF HKRVSIDVRIFNMLFQVISSY PDVDVIMVSGNHDKVTNSL YSDSALAPFSALPNVTVCST LNKIVKQDYTLYAVSYGEEV EEMKAWIKEQADNLDHETV NILSAHIGVDGSSTGKYSHT LGGAFKVADLYPDKFDIVTL GHYHKRQFLGNLSNVFYVG NTLQTSFADEGQEKGFYDIT IEGKKWEQKFIKTDYTPFE (SEQ ID NO: 220) | 351 | putative exonuclease [Enterococcus phage phiEF24C] | YP_001504155.1 | 0.0 (349/351) | exonuclease | Metallophos, calcineurin-like phospho-esterase | pfam00149 | 8e-04 |
| 91 | 74796 74680 | MLKFKRVSAENYMSIGSVSI DLDNQGLVLIEGINDTNETF QSNGSGKSTLLSTVTYALY GATPSGLKADAVINKQAKKN MSVILEFEKDGVPYRIERYR KHSKHKNTIRFFQGTNDITQ KSVADTDKKJQDVFGIDYLT YANSIMYGQGNVEIFATATD KGKKQILENLADIGVYRYAQ DVAKERAQKALALAEELNR QYIAKVYEKDGLTQSYNSAL QQYENTEKLIQQKESELANA ELVIKQSEKNLSEGRAL (SEQ ID NO: 221) | 630 | putative exonuclease [Enterococcus phage phiEF24C] | YP_001504156.1 | 0.0 (6207630) | exonuclease | ABC_sbcCD, SbcCD and other Mre11/Rad5 0 (MR) complexes | cd03279 | 8e-09 |
| 92 | 76697 77362 | MKYTLSRELNEGTIFVPTSS SNEGKLFSFPLGTLFDWYP CCPRYEYQYSTSRKKLYLR LLDSDKTLVARYGVGDNKK RVISKIACFNENEWYNEEVA NENAELFNFAEQYDIVTPLK DDYTLKEVDDSISKVLDILDL LYTNQKVKVBEELINKVDTL QLSKPDSDELKQAYKDISEY MRLDREEKATYVLSRSLDSL NSVYEKFGNVYTMLNIMRK VVA (SEQ ID NO: 222) | 221 | hypothetical protein EFP_gp043 [Enterococcus phage phiEF24C] | YP_001504157.1 | 4e-123 (219/221) | | No putative conserved domains have been detected | | |

FIG. 5V

| | | | | | | |
|---|---|---|---|---|---|---|
| 93 | 77363 | MFTDLLSNELGSPKYAVRD YRYNCPFCDYDTKYKFYVR VEEGHPKNNLWHCFKCGS SGNPVSFVMKYYNVSFKEA LEILEEYGYRFNNIKNYVPKS DKLTDEEYLLLLGSLGKPK EETKQAKKELVAPPLPDGFK LLSQNLREPEAYPFLLYCNK RGFTLNDIYIHNIGYYKDSW VPLENGKSVRLKDHLVFLTH GKDGKYQYWNTRAIGQSFI KSLNAPSKEGEHSKKDTIFN INRASQTPQIVITEGVPDALT (SEQ ID NO: 223) | 352 | putative primase [Enterococcus phage phiEF24C] | YP_001504158.1 | 0,0 (350/352) | primase | CHC2 zinc finger | pfam01807 | 8e-10 |
| 94 | 78438 | MRYTLEDLHAGMKLRCTDS KNYSFWTTNKIYEVTKKESG SLCIFDDYGIESLDEDILVRL NGNTGNAEFEVVSKVMKDA DYTEEDLEEGMLLHCKDGM SFPWWATGQTYEIYKGEKG ILFTKSGDGNQYCAKEIVAR LNGSASGSFELLERPHKTEL EKKVFARIKELKEKKLCLFY KQQQIKIEENEISIEISKLSEA LKAIDVLREFE (SEQ ID NO: 224) | 210 | hypothetical protein EFP_gp050 [Enterococcus phage phiEF24C] | YP_001504159.1 | 2e-90 (185/210) | | No putative conserved domains have been detected |
| 95 | 79096 | MGRVSVYFLNSRNIMDEDE TKRTYHGTFNSMKEAEQSV RDWWKANDFKGGTLRIIEG TEDGIVRWDYGNHTGFYLF VPEGAVVKYTIREGAKKPKR GRENDVAHDLFTADDGWI PGRLGSNVISTGICTSFDPK QYGLFINPRGGMMKYPTLG NTQGVVEGEYRGEVGLPLK NTFSLQLDARAVSKNVLTIN EEGKLINIPVTVARSMYPSF NALYEKQLEKLSEELQLVYG GEVRISNADEYVVAGTLFIP K (SEQ ID NO: 225) | 294 | hypothetical protein EFP_gp051 [Enterococcus phage phiEF24C] | YP_001504160.1 | 2e-171 (294/294) | dUTPase | dUTPase [nucleotide transport and metabolism] | COG0756 | 2e-05 |
| 96 | 79983 | MLIPEFKPPLLYVMGSFSVM LEKHQCSVTFYLREPYLGTS YDKVKLIKMTYPNYSLITYVG MADNKYKFTLKNKED (SEQ | 76 | putative dUTPase [Enterococcus phage phiEF24C] | YP_001504161.1 | 6e-37 (76/76) | dUTPase | No putative conserved domains have been detected |

FIG. 5W

| | | | | | | |
|---|---|---|---|---|---|---|
| 97 | 80215 | MYTKKEEVVTVKIHLVDKEQI RVGDIVGYKKTIRGFDAKRV KDTLSVTNQIGVVSRVCDEY ITVHDFFDKCSREIWAKTFE NLEVRKEDGNSLLRRYENE FR (SEQ ID NO: 226) | 80523 | hypothetical protein EFP_gp053 [Enterococcus phage phiEF24C] | YP_001504162.1 | 4e-52 (102/102) | | No putative conserved domains have been detected |
| 98 | 80510 | MNFVDYFNQMQNLVIEEKT DEYVLLEKEHGQKYYTYQE LEGALSTVARNTAFMVENY NLMQDINLKIVLKKLKDSGTI TEELEKEILKEFKNIESLMED ETYE (SEQ ID NO: 227) | 80821 | putative phosphotransfera se/anion transport protein [Enterococcus phage phiEF24C] | YP_001504163.1 | 1e-50 (102/103) | phospho-transferase / anion transport protein | No putative conserved domains have been detected |
| 99 | 80814 | MSKESKRNKRIGELSEADM RVWAEMLATGQVHDKNHQ KQLERLSKRSVSLSDVTTIV EFMGKFRNDGYISSLIEQQAV FDNLLTKLGVTEENRLEAKA EYEKELSLIQEKQKELESIK ENKEK (SEQ ID NO: 228) | 81185 | hypothetical protein EFP_gp055 [Enterococcus phage phiEF24C] | YP_001504164.1 | 1e-63 (123/123) | | No putative conserved domains have been detected |
| 100 | 81205 | MTDYSAVGKKSRNKGGRFE RQMAKELTEWWGYEFNRV PASGGLHWASSNNVAGDIV VPSDANFPFVIECKNREYN TIENLFLNNKEIKNWWAQVV GDAKETKNIPLLIFTRNRAKN FVTMAYNEKLVNEIEKRGYP LMVSNITYVDDYKDTHCYKT FTTVLDATSFKPYGSKDXD YFLFYFPSDYNWEDSLVYE TTIMDDAKQMDAEDSLDAL VNSYLGGE (SEQ ID NO: 229) | 81873 | putative resolvase [Enterococcus phage phiEF24C] | YP_001504165.1 | 2e-127 (221/222) | resolvase | COG1591, holliday junction resolvase - archaeal type | COG1591 | 0.002 |
| 101 | 81875 | MAKTYQEALATVQSYLESD SVMKETSSISVSFSANWTG EREDYVIDTLTYDIDLRVFSL ETAHVVAIGKKLPQDSNEHA ELLKRLKKEFKQASKKLRED (SEQ ID NO: 231) | 82174 | hypothetical protein EFP_gp057 [Enterococcus phage phiEF24C] | YP_001504166.1 | 2e-48 (95/95) | | No putative conserved domains have been detected |

FIG. 5X

| | | | | | |
|---|---|---|---|---|---|
| 102 | 82180 | 82559 | MIDNVNSPSHYTQGEIEVIE VIEYITAKYPAEIRYHLGNVIK YICRAPKGGKLQEDLNKSS WYLKRAQLVLTWSPSSYTG KCKGFLENFLFKNSHRDAQ LIEIPEEPIIEKFLFQTAQSYN KEQQNYIISALMELNSSSGD VKTVLENTENYLKFITT (SEQ ID NO: 232) | hypothetical protein EFP_gp058 [Enterococcus phage phiEF24C] 159 | YP_001504167.1 | 1e-87 (158/159) | | No putative conserved domains have been detected |
| 103 | 82762 | 83546 | MTKAPRVKRLNIYNTDRYFN INLMKKEDIAKKIKVNRLNEE EIEREMDELASNPLKTPIGY MDRTNEKSYILYQEKYTND RLIQKLFKHAGSVSYYTDTIV PYYIIEQISKNLTSEVIYPTKN SYENREIENVQLAFTACPVTI DCPVVLPDVSPYDVLFALHP LKTNVDKIQISFPCLTEEEFD TRHEEYYHKVGSHYEVKSE YKYKFFKYVQTSLSIWAMNI WLVCDSDEDYNKIDRYIQKE KIKRNANRERA (SEQ ID NO: 233) | hypothetical protein EFP_gp059 [Enterococcus phage phiEF24C] 284 | YP_001504168.1 | 7e-153 (284/284) | | No putative conserved domains have been detected |
| 104 | 83539 | 83850 | MSKDKTINRTDIARTISHHTG YRMKDILKILEVEDEVVAQA VSQGISVKNHKLVWKLNIKKK PEKVAWDGINSKSFIQPEKY VVKFVPLSKLKESIDTYNKE SK (SEQ ID NO: 234) | putative integration host factor [Enterococcus phage phiEF24C] 103 | YP_001504169.1 | 2e-52 (102/103) | integration host factor | HU_IHF, integration host factor (IHF) and HU members of the DNABII protein family | cd00591 | 3e-04 |

FIG. 5Y

| | | | | | | | |
|---|---|---|---|---|---|---|---|
| 105 | 83940 | 87011 | LKILFLQEYIRENHVHNGKN GQTVDFKRTEMGKKLTGLL NTIGLTGRDYAVDYVYDMIP EVQKVNPRTGKPIKYKTPTL RQRKEPEERLLRRLMKYKP DIIIPMGEMGCKNLLGSTSIT KNRGVPTKKTITNENILRTA DEQGLEVDEVVDSFETWVL PMFSMEYWTANPNIENFIM ADIDTLGKFVQEGEQAFIPK KVDYEFVDNIERVRQIFGFL DKTKPVTAWDLETNSLRGD LLGAKPLVMSMSWLEGQGV (SEQ ID NO: 235) | 1023 | putative DNA polymerase [Enterococcus phage phiEF24C] | YP_001504170.1 | 0,0 (1021/1023) | DNA polymerase | cd08444 | DNA polymerase family A, 5'-3' polymerase domain | 2e-86 |
| 106 | 87114 | 87656 | VLNLRVDDLEFKTIKIDDNG EVVTHDLQTELQVNEFNVR TAFLEQFAKYTVWTSILERL RMYQENYELKAEKKAELY EPSRVALINQGVAKPTKDQI EAQIMLDEDYKLRQSIVNL SFNVRQLQYIVKAFEQRKD MLIQYGADLRREYEYSQKV SMPDPMKNKVANGFSDFQ WNLEQ (SEQ ID NO: 236) | 180 | hypothetical protein EFP_gp062 [Enterococcus phage phiEF24C] | YP_001504171.1 | 3e-100 (179/180) | | No putative conserved domains have been detected |
| 107 | 87712 | 89001 | MNFQEQLQQQLKQQNIGER EAVDYPSNHLKHKELYFPKA ENGQPSTLYVRVLPPAVPG ENYNVSAREAFLTTRNRNG KDLKSNFIFSEHPNAEDILEQ AMIRWNAENRVPNPYSRNT KPRQRYYVNVVQLIINQQTG EVMNYETDSNGQLMVRLLKL PQTACMAINESLSNPMLRP QFSPDVPEEVAQYSFISSAD AFPISITKPPRSNKPTSYNV QVISNRSLGALPQGWENLL EDLKYQATPSVEYNREFIEY F (SEQ ID NO: 237) | 429 | hypothetical protein EFP_gp063 [Enterococcus phage phiEF24C] | YP_001504172.1 | 0,0 (428/429) | | No putative conserved domains have been detected |

FIG. 5Z

| | | | | | | | |
|---|---|---|---|---|---|---|---|
| 108 | 89086 | 90333 | LARKRKSEEIDFGTIDLTKEV GLTTFTDTKFSNVSDRLPTM IPQLDYILGGGLPFGRMVEV FGKNSSGKSTLAVHLTKVA QMLDVPTVMIDVEGTADPE RLAELGVDFSAGGVFMVEP KQNKDGSKDTITVERVAEEL QRLLPVFSKLGKPVLIIWDS VAQTASEKELEKGVGNQQP GIKAKAMAQFAQIIAPLMTN SKALFIAINQARDELGSMFG GVDSPGGHALHHMASLRLE VVKASQIIKNKELNAFGAEE (SEQ ID NO: 238) | putative recombinase A [Enterococcus phage phiEF24C] | YP_001504173.1 | 0.0 (414/415) | recombinase A | RecA | cd00983 | 1e-36 |
| 109 | 90387 | 90773 | LRKGLAPNPFFEILEKHQDS SKRTMTMNSSGTPSSLQPI RDMFLKAMREGKRVLIENS DLSSANSVVIEIEYVGNRWC LGYQRVLFYGMELKIPHTIH FCDVYGAYGHDAQKVKRQ VKVVFEGDNPFE (SEQ ID NO: 239) | hypothetical protein EFP_gp065 [Enterococcus phage phiEF24C] | YP_001504174.1 | 1e-70 (125/128) | | No putative conserved domains have been detected | |
| 110 | 90766 | 91380 | LSRDVQKEEKEIRNGNRFIT ETHGKGVFPRDVDRLYHKY SNLRYKVYNTHKDSFNSEA SRKELKSYIDEQFIKLTKEYD INGEVDFPGYIKKALNLRVR HSYVKGRFRDTARERLGTQ DNEVELLGIDDSSQADIED AELIESLLSKANFSEIELAVF QQLIQGTVRDARIITELSENY GVSKKAVKDAIKNVREFVLI NLTD (SEQ ID NO: 240) | putative sigma factor [Enterococcus phage phiEF24C] | YP_001504175.1 | 1e-112 (202/204) | sigma factor | No putative conserved domains have been detected | |

FIG. 5AA

| | | | | | | | | |
|---|---|---|---|---|---|---|---|---|
| 111 | 91441 | VEQNNTGKYAPFIRLIVMGIS FVATGLTTIFGWEPLPFTDE QMNQGLMLVLSVGLAIYNW YKNNAVTSYGKAKEEAGKE VVGTRQDFKNRD (SEQ ID NO: 241) | 91 | putative holin [Enterococcus phage phiEF24C] | YP_001504176.1 | 2e-46 (90/91) | holin | Phage_holin | pfam04688 | 6e-04 |
| 112 | 91764 / 91716 | MKIDEISKLELPNILFGKFLVV ETISDGYTGTVSGHYNYEID QKSEETYYPVFWNDKLNKF IRSDELVYTNKNKVYYVCK TTIDPYNHAVVDELTVEEGM DKDKRTLQAFKLFVNDLFSF GSYNIFLTGNLSLENNPDIVL VSSVSLDKQTAKMYTERTL ELTATVLPEGATNKKVIFSV DKPELLGLTVSDNKATVTSK DKAGTAIVTVTTEDGEHTDK CTVQIEEYIKVTGINVSGESA LEKGKTYKFTASI (SEQ ID NO: 242) | 320 | putative Ig-like protein [Enterococcus phage phiEF24C] | YP_001504177.1 | 0.0 (319/320) | Ig-like protein | PHA02283, hypothetical protein | PHA02283 | 9e-12 |
| 113 | 92747 / 92726 | MAKEILNIEDLLKPETLEVAI DGKYLIVPTLSDGFTGTVAG GYAYAVTKKGTDYTVNELIY NQKDNTFKPSDEPIIITDDNE IFFITRTLEDPYNYPVVATEK LKTKDVVKEKQVLQAFLAFAD DRFKLGVYNVFLADEPFVY GDKTE (SEQ ID NO: 243) | 147 | structural protein [Enterococcus phage phiEF24C] | YP_001504178.1 | 8e-78 (147/147) | structural protein | PHA02283, hypothetical protein | PHA02283 | 4e-19 |
| 114 | 93297 / 93190 | MNDNKEKCVKQEIRDTYKG YDILLDEENGFFYVSVLDPD GKEIISGFVEADKPIEEYYKE LLGKCDQDISFKDLLGFLNG RRDTERTDIRFLKRDSGV (SEQ ID NO: 244) | 98 | hypothetical protein EFP_gp070 [Enterococcus phage phiEF24C] | YP_001504179.1 | 1e-41 (88/94) | | | No putative conserved domains have been detected | |

FIG. 5AB

| | | | | | |
|---|---|---|---|---|---|
| 115 | 93598 | MTKIKLITKKNTQGYVMNTL LRRFYKNINVDVEFLNKFNLP DIHNHIGEYDAVIIVGFPFFE SQRGALLTALSSMDNPFSK VYHLATFGDTYRNEGSFRS FVDEVISPVGHFVELIIDLTK FTNTGTKEDEQNVVALAKE ALVFAKDIIEETDNYNRYEVT DRTISWVLLVDLLGENLYKV TEPSKELDTILKEQEVLVDAL NINMQDYVLRTIGKMSANVI NGTVVCFGYAEQHVNEVAH KLINFYKSHNYQKVI (SEQ ID NO: 245) | 317 | hypothetical protein EFP_gp071 [Enterococcus phage phiEF24C] | YP_001504180.1 | 0.0 (315/317) | | No putative conserved domains have been detected |
| | 94551 | LKNNEPLEKLLDKLDEPRIL QTIIIGSLQRSFNRVHVGKFN KLAQEFDLDKENLYSLKALV KEIEEDKELHELYEASMAGK ITLEAVRKVLLQDDKSSFDV LSSYVENQAVLARNREFG KLQREGAYLDHLISGLKTYL LAELKDMSSLKYINKNLKAP KVSSDRELILCLSDWHIGAF VNNIDTGGYNFEIFKERLEK LLEEVFQVAMEQDIKKIHVY HIGDIIEHINMRNVNQAFEAE FPATEQIAKGIRVL (SEQ ID NO: 246) | 427 | hypothetical protein EFP_gp072 [Enterococcus phage phiEF24C] | YP_001504181.1 | 0.0 (425/427) | | |
| 116 | 94605 | | | putative DNA polymerase [Lactococcus phage Q54] | YP_762586.1 | 3e-16 (71/255) | DNA polymerase | No putative conserved domains have been detected |
| 117 | 95900 96274 | MGGNLVYILLAIAYVGEGITA FTNTKRKERYMIEEGEAPLP RSSYVFLGINYLLRIAIAISLIF IIPTSLQLNVTGIALFTLMVFV VPFIARIIEVVIRTAIVRYVQK QYIKQLEERKQKRETN (SEQ ID NO: 247) | 124 | hypothetical protein EFP_gp073 [Enterococcus phage phiEF24C] | YP_001504182.1 | 3e-62 (123/124) | | No putative conserved domains have been detected |

FIG. 5AC

| | | | | | |
|---|---|---|---|---|---|
| 118 | 96313 | 96933 | MNFTEVISPNGETSLIDVNN PPTLIRRGVLSIKTKVNNEVK ETPVYIVELAEELTGTDVVS VYKVKEIGDSIQKDYIEEKVT PRFKSTTYLGELAQKIKGRSI KEQRRVETKPPLFLAPVVN GIDTFTGIEGKGFYEREEDR HILLPDGKPGIAYGDNTGVFI GLSSIKWDKAYVDVESITKG YLSQKQIWFNLDGQRPQFR SETL (SEQ ID NO: 248) | 206 | hypothetical protein EFP_gp074 [Enterococcus phage phiEF24C] | YP_001504183.1 | 2e-114 (206/206) | No putative conserved domains have been detected |
| 119 | 96933 | 97673 | MTDKQFYEADIQELILNKQRI FGDIGKSAIVFEKAIMQGNTI CDCLVFTEKRGLIGIEIKTER DSTKRLNKQLSDYEKVCDY VYVLCHDSHVPKVEQILTRH NHKHVGILAYTEFMGEAML GEYKQPSRSPKKSAYHMLN ILWKEDLIRMLGTFRRYGDR LEANGAKVMKTNSRSGGVS GLYVK9TTARRMTKPELINN LINRVGGTEEATRVFCDVFI HNRNHPEKAIKLRHFKAKEN RGDLDGV (SEQ ID NO: 249) | 246 | hypothetical protein EFP_gp075 [Enterococcus phage phiEF24C] | YP_001504184.1 | 3e-143 (244/246) | No putative conserved domains have been detected |
| 120 | 97883 | 98169 | MQFKGAKYGSWNTVVGKN YVGTGGRTSGSNTKRLSTK GYYQVGFVKEYQNLTEKDI MLKLEYGKDLVSSYTGVPA DMIKLRKKEEQTLASLDTV YYVSIGKEPVGKLSIRAQRR FREVGLTFIYLEKNYVQRKL RGGNVRSVGYTNATKSQKR KADRRKSNKSKTTR (SEQ ID NO: 250) | 168 | hypothetical protein EFP_gp076 [Enterococcus phage phiEF24C] | YP_001504185.1 | 2e-90 (168/168) | No putative conserved domains have been detected |

FIG. 5AD

| | | | | | |
|---|---|---|---|---|---|
| 121 | 98183 | 99040 | MLKKGKEVTLRKFYNIITDKE SVILGARYTSSIMTDIPIT TFEDVEVDLKKETYAGTISF RPVGERQINALSLLKEASTA YGGYGEFLDDTIEKPLINSD FAVDVSLADSAFSNLQEIPF NLYMSSPKVFYTEVSIRGRK HMQYVLEDESSSGVTSTLA LVFRKKLYDGETLLGVHTYT EALARVEGIKVLQFIANGSVL EQVIGAVSVLGGSTGTTLFP MFDDMVMQFVMIESVPWV HISCIDTGAIAFKEED (SEQ ID NO: 251) | hypothetical protein EFP_gp078 [Enterococcus phage phiEF24C] | YP_001504187.1 | 2e-163 (285/285) | No putative conserved domains have been detected |
| 122 | 99144 | 99989 | MDYKEKVYYGALTWLGTLG ERRYLGQMRDVLAVYELGS RYAGYYTENSDYDYMVYM PSPHDLMYPTTYKQETKID GNKVEVKYMSIMEYVYRIEN GDLEALQMLNATSSQSFFG EPIEGIIDNKRTRLVTYMKEL EYRRETFTYLAPEKLFRGVN GRIKATKARMDKAIENDDME VAVIKGAILIRYFMDLLVVLAD GESIREGLTFSPIIANIIREFR EDCESAQAKTLINTAQVLLE ADREEILNSIKDHGLS (SEQ ID NO: 252) | hypothetical protein EFP_gp079 [Enterococcus phage phiEF24C] | YP_001504188.1 | 7e-156 (269/281) | No putative conserved domains have been detected |
| 123 | 99982 | 101610 | MTKLEQNKEILDIFNRKGKV TDKVEESAKIMLELDHDYDF GTGDIAYTERGTDKKGRFYL ESRLFIHKLMPYGFILNAVVS KVHYGDQEETLEREVSRVY ELEYNLRIDKVAVLIKNGKPL NFSENNISNMFSGHVAQNIL EQLDTMSGSDMYVSVYKRV SRVKDEQIGKVSRFFDRLM KYNKIELIYKSGVPEGFALAY AYRVVVGEGKVRNKWYE PVKSVDYLDKEQTNPAKHL GIPKSIFKIICEGGLEWTF (SEQ ID NO: 253) | hypothetical protein EFP_gp080 [Enterococcus phage phiEF24C] | YP_001504189.1 | 0.0 (522/542) | No putative conserved domains have been detected |

FIG. 5AE

| | | | | | |
|---|---|---|---|---|---|
| 124 | 101929 | MAKKEVNNSSVLLNLYNNK LLVSKVDEALDEGKPYDFIIA FCKEKFDFEINKPALSRYKE KRRESLETGVDLESLLDKRR KSGKIIDIKSKEVTPLPNETY DNTFGQVEQIYNDVEVLDTII QKGFNSLKEVDYVEAPLAM KAIEVKAKITANQFQGLSLT GLRELRLRQSAKEQAMTEII LQFIPEEQIHEEVFMAIESAE KEFYENLDLTEEDQRITKAL QASGMDII (SEQ ID NO: 254) | 229 | hypothetical protein EFP_gp081 [Enterococcus phage phiEF24C] | YP_001504190.1 | 3e-128 (229/229) | No putative conserved domains have been detected |
| 125 | 102629 | MVENLREVNYKTLTLEESLH ALLEGKTLIVKGLEQRRKLD VLVRIFSEGVVPVTQISYDTT PADGYWRTGYWQIYDLPIN ALSTYPCFIYDDLNTDELPK FMIGDTVYYTSKEDSIKDSAI VISVYKDDANNKWVYKLSR DNEIYAESEIRRDRL (SEQ ID NO: 255) | 155 | hypothetical protein EFP_gp082 [Enterococcus phage phiEF24C] | YP_001504191.1 | 6e-84 (153/155) | No putative conserved domains have been detected |
| 126 | 103197 | MANILDTLKWLDKGDKVTIE FDKERSKYAKLTLHDSSAKT NIVRNIVFYDLDKGVYAYTG EYTPVWDNLLDDMRKTQGA EPEIKTTKVNQLATYEDALK FIETNGTPYIIGEEVIVKVKDA KELALMLMYFRDAMEELRG EYDPKKHHVDMTIELSKDVL KKMAVPRHELDLSLGGLMR AVSHNVGEDLFETLGFDYM KQAWEVLVNCLSLDTIHEVP FRVLDELEKVTDSMSTTDHI VTLYAGRELKKFYSEEE (SEQ ID NO: 256) | 759 | hypothetical protein EFP_gp083 [Enterococcus phage phiEF24C] | YP_001504192.1 | 0,0 (746/759) | No putative conserved domains have been detected |
| 127 | 105538 | LILFIFSIITMLSMFLYLFGM ASVALIELGLLMGSQNDITK GAHSLLFTGVTLTVVTETTK QCLLLF (SEQ ID NO: 257) | 69 | hypothetical protein EFP_gp084 [Enterococcus phage phiEF24C] | YP_001504193.1 | 9e-26 (61/68) | No putative conserved domains have been detected |

FIG. 5AF

| # | ID | Sequence | Length | Protein | Accession | E-value (identity) | Function | Conserved domain |
|---|---|---|---|---|---|---|---|---|
| 128 | 105816 | MYDSYGYLDWASWLFSIVI GSAVAAFFTLAVVGITFDVA PSHGVTKSHELHPIYENSKV VVEAKKEQFEINVDGGLVAI DAEGTTILSTKGEIKPKIVFT ENYINNNWWTRFLGIAGKV KDTSSVLYLDSGTLVYNKPE KNSSAPDLKIK (SEQ ID NO: 258) | 150 | hypothetical protein EFP_gp085 [Enterococcus phage phiEF24C] | YP_001504194.1 | 3e-78 (144/150) | | No putative conserved domains have been detected |
| 129 | 106343 | 106268 | MSYTKRALEARGYDFDTMS MLEKMNALLELLEEPEFQE QMRKEYEEFSKECATNGE (SEQ ID NO: 259) | 58 | hypothetical protein EFP_gp087 [Enterococcus phage phiEF24C] | YP_001504196.1 | 5e-24 (56/56) | | No putative conserved domains have been detected |
| 130 | 106503 | 106775 | MENEKLESYFMKEIAPILDEI EMSEELIKGMENNNPSDMIT VSFSKEEVDILLAMLDDLELP RLDSGSELFSPNLVREAKLQ LIKNKLTSK (SEQ ID NO: 260) | 90 | hypothetical protein EFP_gp088 [Enterococcus phage phiEF24C] | YP_001504197.1 | 2e-42 (90/90) | | No putative conserved domains have been detected |
| 131 | 106883 | 107134 | MNEQKKVYAKLTEDEAVFA CELGDKIKQIRESQELSRLE LAKRAKVDHSTLLIIEQGKRL PTLRIMMKLSKALHRELAISF TD (SEQ ID NO: 261) | 83 | putative transcriptional regulator [Enterococcus phage phiEF24C] | YP_001504198.1 | 4e-40 (83/83) | transcriptional regulator | Helix-turn-helix XRE-family like proteins | cd00093 | 7e-06 |
| 132 | 107146 | 107433 | MRGSLDYYNYLYQTIENRPT EELDVLYDGLYKKAGDLFAI DNFQGVKEGRLILKLKAIRE EINSRIDEEIDLYLYNIYDSIS DEDKRVNWLYEV (SEQ ID NO: 262) | 95 | hypothetical protein EFP_gp090 [Enterococcus phage phiEF24C] | YP_001504199.1 | 8e-46 (94/95) | | No putative conserved domains have been detected |

FIG. 5AG

| | | | | | |
|---|---|---|---|---|---|
| 133 | 107436 | | | | |
| | 108224 | MFSVVKADSYVKSDIEMYEF KNVKSLALTKKEKELWSGKI AKYVNEFIVNAYGDYHGNKI PEINVVINGKLKKVLGSFVQ FTNTNIHYIEISGRFVKEVILL QETPLAQRALDILMDVARHE AIHYTLCYLNSLSGGDLPTF NYHDGGEDFEKDLCLTGTS PSGATKEEYIYSSFTLGAIRC RHHSTCPECGLLETYMYTRG RYYCYNGCVGDNGRKIIFRP QGDIAMIDEPKSKAKPKVEE ALKDYKGALKLPY (SEQ ID NO: 263) | hypothetical protein EFP_gp091 [Enterococcus phage phiEF24C] | YP_001504200.1 | 1e-148 (255/262) | No putative conserved domains have been detected |
| 134 | 108306 | | | | |
| | 109379 | MAYVTNIDVVADGLDLYNG NYVVERGQVVTFKLHVATW NNEPTPENAYAIIRNNGVDY KSKVDEFGNAEVTFPVNGR PDQVTTSIFALTSGYEGDMP RVMSAIFSDETEIKQTVMNV TASINGEPVSREGVFLERDQ VVTVDVKATLSTGKFWEGA QVGVYNNNTEYLGDLDADG YGSVTFQVKGKQGMDTSAI YVFVKDHEREATLTVPVKFT NTTVTTETSTEESSTVDTTT GTEESSTTDTTTVESSTTDS T (SEQ ID NO: 264) | hypothetical protein EFP_gp092 [Enterococcus phage phiEF24C] | YP_001504201.1 | 0.0 (355/357) | No putative conserved domains have been detected |
| 135 | 109504 | | | | |
| | 109805 | MSQVSKHGEKRVRERVGV NKSSVDRQFELALERGYRQ KELTGRLLKKWVVSRVFNSK YPQTCILYNGKCFIVSSEGT LVTVLNIPSNLLKDFAKLSKK RGK (SEQ ID NO: 265) | hypothetical protein EFP_gp093 [Enterococcus phage phiEF24C] | YP_001504202.1 | 3e-51 (100/100) | No putative conserved domains have been detected |
| 136 | 109808 | | | | |
| | 110110 | MDIMDIEFLEEHKQLVKEHV EQELKLMHPLKKLQVMTDW LGDTEDKLSQGDLDYFNDL TETELIEAMDASEIVESYSDV LLDFIDYYNIDLTGLEEQLGV (SEQ ID NO: 266) | hypothetical protein EFP_gp094 [Enterococcus phage phiEF24C] | YP_001504203.1 | 1e-48 (99/100) | No putative conserved domains have been detected |

FIG. 5AH

| | | | | | | |
|---|---|---|---|---|---|---|
| 137 | 110113 | MDKAEKVDNIVRQVTGAIIK TTAKVAFIVFVLTFAGILVGY YSYSFLTNAGWFALPMILSV DLLYVAVLGGGLAFIFAEVYK VVLEVKKIVKRGGGL (SEQ ID NO: 267) | 97 | hypothetical protein EFP_gp095 [Enterococcus phage phiEF24C] | YP_001504204.1 | 8e-46 (94/97) | No putative conserved domains have been detected |
| 138 | 110403 | MSNKTLEQRVIDANKEINDK LNESSIIRKQIEELEEQEAILL SDVEDLLDYLENIGVDL (SEQ ID NO: 268) | 59 | hypothetical protein EFP_gp096 [Enterococcus phage phiEF24C] | YP_001504205.1 | 2e-23 (59/59) | No putative conserved domains have been detected |
| 139 | 110595 | MNKKVEEMTMEEKDKALIA MGLIDVTQEADWVVLATCE ECREEYEGEEYEEGDCAEC EHCGGEYFMIETALEGTRC GRCDDYFDMWDYFEFEN EGNPYKDKHCEHCYEELVS MGMEEKF (SEQ ID NO: 269) | 121 | hypothetical protein EFP_gp097 [Enterococcus phage phiEF24C] | YP_001504206.1 | 2e-40 (102/120) | No putative conserved domains have been detected |
| 140 | 110987 | MNELEELKNTLRQKLSMLE SYEMREASFWIMFNGILRTI MSVAVVAFVSYAKHVRPDN VATWFLALIWWIFLAEGAKG AYDAIAFGIHRKKFAKHIKNM RGIITITQLLIEEDEEKLNGGK LDE (SEQ ID NO: 270) | 125 | hypothetical protein EFP_gp098 [Enterococcus phage phiEF24C] | YP_001504207.1 | 4e-62 (114/125) | No putative conserved domains have been detected |
| 141 | 111357 | MSKDEKLVEWFVVALMVIV WLLITFSILYTIVSLPFMVHE GDWLGIVRNVLLDIVVLVIGV VATMLQLRFKKGMEE (SEQ ID NO: 271) | 76 | hypothetical protein EFP_gp099 [Enterococcus phage phiEF24C] | YP_001504208.1 | 5e-34 (76/76) | No putative conserved domains have been detected |

FIG. 5AI

| | | | | | | |
|---|---|---|---|---|---|---|
| 142 | 111691 | 111965 | MGYLESAIEEIERVLLGNKS RDTEEVYLNNAIRYIKKELKK KEVEPTWLNEPQTLFLNWF NELYAVGGLTIHVTEAVGFLE STGGRMKYPEAYSAFSNLS ENELLEVYSKFYTGLFLKAQ GGELE (SEQ ID NO: 272) | 124 | hypothetical protein EFP_gp100 [Enterococcus phage phiEF24C] | YP_001504209.1 | 1e-51 (113/124) | No putative conserved domains have been detected |
| 143 | 111962 | 112219 | MNFHGKVFHDKVFDILSRD YPDWQRYQTEKRPHPNEL RKDFAIDSTDSRYEEYVMG EFNVETASGDVKVYAVGIRR VVHKRAEEE (SEQ ID NO: 273) | 85 | hypothetical protein EFP_gp101 [Enterococcus phage phiEF24C] | YP_001504210.1 | 2e-26 (55/73) | No putative conserved domains have been detected |
| 144 | 112225 | 112818 | VEYTEKDIKEGMKLRCTDNS NVGYWEVDKVYEVTRNKDL GLVIAGEGERSHRTVKYILE VLNGDSKIKFEVVEEKPVRF AKVTCVYPPDRGLVEVGHC YEVLKEFPTGSVRIIYLNSKL GNHSLLPDQFVFVDEPSND GEKDVEELDVEAKILADIEQL KTEAECLFAKRDRVNEQAL NLNAKARKLEESLEVLREYM (SEQ ID NO: 274) | 197 | putative cytidine deaminase [Enterococcus phage phiEF24C] | YP_001504212.1 | 3e-77 (153/197) | cytidine deaminase |
| 145 | 112860 | 113702 | MIYINFLEDFASSWSADKR YRVRRIMTGSYAIIDNYGH VRFSSDTARGVLKNIEQEYA TNKVELTLVEEEAMNKPRFK VGERVKVSNDLQAFGIEYKT HIASKMLGYAGKEATITRVW GSNVRYFINIDGTHQDWCW TEDMLDKIEEEPTLSVRCVE AVHPFWTKGKDYEINLTSD GRYRVWDDEEDGSSGKSIK ELLDVINSSGNKFELLDETP SEAEPRLNHDMSDLEKIEAK ITALSEESYQLFEKSEEL (SEQ ID NO: 275) | 280 | hypothetical protein EFP_gp104 [Enterococcus phage phiEF24C] | YP_001504213.1 | 1e-155 (264/280) | No putative conserved domains have been detected |

FIG. 5AJ

| | | | | | |
|---|---|---|---|---|---|
| 146 | 113715 | LNKKETLLNTTVTFLGGTSQ SSRPKGKQTLCEMQKSDGS VEFIFDGTVFYVHSMVVVYM ANKKHSMQATVSAIDGNYK YAGITFKLKVDYKENTLLEE I (SEQ ID NO: 276) | 101 | No significant similarity found. | No putative conserved domains have been detected |
| 147 | 114018 | 114017 MRKMVICRLECVSKDKDNL GEWTVDNIYPVFESELGKV YILDDEGTTCSRDSVSLIISS MASFGVTFRVAKDKAEDPIP SNPQSSTSLEIVKQYEHLEE FIDSLSSNQRVVSHSVDPNS QWHYIYETKSAELGGVTLE ELLDTLVYNVHVVWMERSK RTYEPLESHTFKWEYGTKN TEDWEKIVPLLGYK/FNTNL NSNRGFHITILK (SEQ ID NO: 277) | 209 | hypothetical protein EFP_gp105 [Enterococcus phage phiEF24C] | YP_001504214.1 | 3e-116 (205/209) | |
| 148 | 114810 | 114968 MYFVIVVNGQHRTLLKVTGK EWEMSPHTEEAVIEVALDT CYTYIENQEAQKN (SEQ ID NO: 278) | 52 | hypothetical protein EFP_gp106 [Enterococcus phage phiEF24C] | YP_001504215.1 | 6e-23 (51/52) | |
| 149 | 114985 | 115125 MIGDFILVVFKQAWKETFCIH DYTVKGVYKTLDNHGYLKC KKCGRIK (SEQ ID NO: 279) | 46 | hypothetical protein EFP_gp107 [Enterococcus phage phiEF24C] | YP_001504216.1 | 3e-16 (41/46) | |
| 150 | 115138 | 115470 MNQRQIKKRMKKVLAILNEV EVVDSDYDSGMVLYVDVAD NEQNRDIIKEVCGILGLDKEK FIAEGKESRLYEETNLASC WHYLMQKEPKKLTIWHSVS KGFSLERYSED (SEQ ID NO: 280) | 110 | No significant similarity found. | No putative conserved domains have been detected |

FIG. 5AK

| | | | | | | |
|---|---|---|---|---|---|---|
| 151 | 115635 | 116176 | MFKKDKKEEKTYREGDLLK TVGGYYPDARLSLGITYPLY KTTNEGWYIINNEGSRVTLIE MDALGIDYAVMEEPLLELKE GDPLLVVSDLKRGVRGLAG AEVQCLNITGEMASLAGTVV HYDKDMSHIAKGLFTVKEN DSYWCVAIAIPLNKVADPDF ALEHLLATLNKKASTKRLJLN EIKYDLNLLHQELDEVSNEL EKLTKNIETIYNNR (SEQ ID NO: 281) | 213 | hypothetical protein EFP_gp109 [Enterococcus phage phiEF24C] | YP_001504218.1 | 6e-114 (203/213) | No putative conserved domains have been detected |
| 152 | 116188 | 116631 | MSMPSDLGKTLKKPIVINKN PDFYELAVGGKVIYNEEVME IAKAFSNKKTKYYLLNTRSN KQVCVPVYHVRPYDTQVEG LKLGDVLDAMHIMTVTLRA VNKHGFVVDEDIIECLVDDV PENALIVTSEVSRIQPEDFG KVTIDYFV (SEQ ID NO: 282) | 147 | hypothetical protein EFP_gp110 [Enterococcus phage phiEF24C] | YP_001504219.1 | 3e-79 (144/147) | No putative conserved domains have been detected |
| 153 | 116795 | 117226 | MSYWNEFETIGDWLDREYD VLLRDGHDIOELDNIWGMAL FALSEGYVLTDGLDKPFLEL TREDLVAGYNHFKEELNGW LRGGKLLEVSGNLATIQGFS FDHDDVLFLEDNNKAYAML VGIIIEARDTYKNGFCKGYYV IPYQD (SEQ ID NO: 283) | 143 | hypothetical protein EFP_gp111 [Enterococcus phage phiEF24C] | YP_001504220.1 | 9e-75 (138/143) | No putative conserved domains have been detected |
| 154 | 117581 | 117880 | MNKYKFTYADIKNLSEEEKE KELKNRCGVLAVECLSTKQL QKKKPRFMWFLNTVIFDSTA ETGGQYATATVKTEPIGDG RFRYCDGWGQLSNGIIELLK (SEQ ID NO: 284) | 99 | hypothetical protein EFP_gp112 [Enterococcus phage phiEF24C] | YP_001504221.1 | 6e-42 (96/99) | No putative conserved domains have been detected |
| 155 | 117959 | 118249 | MFKRLEEYRKNLSNEELKIF NNTMKLLNDNKTDFQERTK NFDKELQYTELENEKEKILIV LDTIRVSNENYKNVISENLY HSIKEMTIIFELLYNL (SEQ ID NO: 285) | 96 | hypothetical protein EFP_gp113 [Enterococcus phage phiEF24C] | YP_001504222.1 | 7e-45 (96/96) | No putative conserved domains have been detected |

FIG. 5AL

| | | | | | |
|---|---|---|---|---|---|
| 156 | 118333 | MNELEEVKEWNNKEEQQE VLNKVIVTFYKEIDLKVKMVN RGLLGQLSAFNELKGMLSGI ELTAKVIAPDNVLPITTHNFL EYLFLGDNEQRAYAKEYLD QFLKSVE (SEQ ID NO: 286) | 107 | hypothetical protein EFP_gp114 [Enterococcus phage phiEF24C] | YP_001504223.1 | 1e-51 (103/107) | No putative conserved domains have been detected |
| 157 | 118750 | MMNGLKRLMKAKRYKKEVK EIITMQKKAINELETLNKNLK LINGNY (SEQ ID NO: 287) | 46 | hypothetical protein EFP_gp115 [Enterococcus phage phiEF24C] | YP_001504224.1 | 1e-15 (44/46) | No putative conserved domains have been detected |
| 158 | 118949 | MTKEELKSYLENYNKPFSTS MDNVFSLFINDVRAVADDFR KGEAFYTCAELIEEQAETLE KSDLEELEEKSGESLVIQDIN GYLYFV (SEQ ID NO: 288) | 88 | No significant similarity found. | | | No putative conserved domains have been detected |
| 159 | 119297 | MIIAENELYLVKNPLNEWDM NYHLIEKETGKDFLIDIGDVA DNEEEREKYELGLLFSDLKN LIVDLLIEYSWKTI (SEQ ID NO: 289) | 75 | No significant similarity found. | | | No putative conserved domains have been detected |
| 160 | 119606 | MTEQQFKKEHILLEPTEMRS GGYLDTSLIDQSQSYYIESR PRVYGGCYVYQVYVTMKDG TVYELYSMTASTRGIVAHNC HARNVLQRDVKQYRDSAIH Y (SEQ ID NO: 290) | 97 | hypothetical protein EFP_gp116 [Enterococcus phage phiEF24C] | YP_001504225.1 | 7e-51 (95/97) | No putative conserved domains have been detected |
| 161 | 120012 | MKLSDIILVGLLVSIVLLWGY LSIMICLQVFRALGGWDIRTL TVCSGLLFAYVFGLKGIWEQ GTGKSK (SEQ ID NO: 291) | 68 | hypothetical protein EFP_gp117 [Enterococcus phage phiEF24C] | YP_001504226.1 | 9e-29 (65/68) | No putative conserved domains have been detected |
| 162 | 120300 | MKLNVIHLLFCLFQEQESYSI LSYESIDEFYSRLGYDLESE WLLRDLGINGTSGLAELLTD YNNLLENEITKAVFSDKWL (SEQ ID NO: 292) | 80 | hypothetical protein EFP_gp118 [Enterococcus phage phiEF24C] | YP_001504227.1 | 1e-37 (79/80) | No putative conserved domains have been detected |
| 163 | 120619 | MNELECIYDSRKSFYGKANL VEEENGISLYSYDTKVATIYT NGLAKVFGTYSQTTLRHIKE PFKQNGLKADTKKQIEKDYL (SEQ ID NO: 293) | 81 | hypothetical protein EFP_gp119 [Enterococcus phage phiEF24C] | YP_001504228.1 | 3e-39 (80/81) | No putative conserved domains have been detected |

FIG. 5AM

| | | | | | | |
|---|---|---|---|---|---|---|
| 164 | 120930 | MLKITKEITLGEFEAWEGGK DRLETIKELDILDEAQQEIEL MIEGAEEVTEMTINDILWFE MDEFIAQFEEEEEEE (SEQ ID NO: 294) | | hypothetical protein EFP_gp120 [Enterococcus phage phiEF24C] | YP_001504229.1 | 4e-31 (75/76) | No putative conserved domains have been detected |
| 165 | 121210 | MTTEEKALNIAENKGTDYK VKGNVLSYYTSYPMEKCTY LVTIDIETLEERKELKKYYK KGLQNACL (SEQ ID NO: 295) | 68 | hypothetical protein EFP_gp121 [Enterococcus phage phiEF24C] | YP_001504230.1 | 5e-30 (66/68) | No putative conserved domains have been detected |
| 166 | 121435 | VAVTINNRIKKLQYERIRKLE KRKRGEPPEFIPNGNYSLEE IELFLHFRKKSEGKK (SEQ ID NO: 296) | 55 | hypothetical protein EFP_gp122 [Enterococcus phage phiEF24C] | YP_001504231.1 | 2e-21 (53/54) | No putative conserved domains have been detected |
| 167 | 121750 | MTKTELQYKKAIGVAIFATSE EDKKQLGNVAPFSIYEILEID LNKNRVYYALNCGERHAVC FTKLRKEEETGDNFILINKQP FFLKDIHKGLTWSKSL (SEQ ID NO: 297) | 98 | hypothetical protein EFP_gp124 [Enterococcus phage phiEF24C] | YP_001504233.1 | 8e-50 (95/98) | No putative conserved domains have been detected |
| 168 | 122114 | MKIGKKEELEANNIPNRADE LLGAVTMEELERDNGGSIFY ADGSPDTVLVHMKKEFSLK PFHCYYFDGIWYIALINI (SEQ ID NO: 298) | 76 | hypothetical protein EFP_gp125 [Enterococcus phage phiEF24C] | YP_001504234.1 | 5e-33 (68/76) | No putative conserved domains have been detected |
| 169 | 122428 | MTKENNVFLNEKELMKEIIE TLENGFDGCYCDLHNEVFN YGTNTDTEELEEYGIFNAIG EIQEYEEEHFGATLTDLGNA SAVADMLYYIKGHEFLFDRL DFNDVLADVAEGLKLDKDL WNEEGATEEVNKAIIKCLKRE VPWLVD (SEQ ID NO: 299) | 144 | No significant similarity found. | | | |
| 170 | 122925 | METLENFGYTWQGIKEVTK EEAEKNVKNGVDTFLLYPD NTESLVISLDELETEGVRFG VEKPVQLLFKVSNSYHNTEE VYYGENVEEIEKKLHDSLEIT AENLTGQEIEEDWENYYKT YEEAMEATYNGILSQLKSEG TIEKM (SEQ ID NO: 300) | 143 | hypothetical protein EFP_gp126 [Enterococcus phage phiEF24C] | YP_001504235.1 | 1e-73 (137/143) | No putative conserved domains have been detected |

FIG. 5AN

| | | | | | |
|---|---|---|---|---|---|
| 171 | 123438 | 123635 | MKLTEKELNTILRDDETGNG GTAFLGETLADFLEESGIDF TNLTLEVNELLENNGIRPIE VVPG (SEQ ID NO: 301) | 65 | hypothetical protein EFP_gp128 [Enterococcus phage phiEF24C] | YP_001504237.1 | 1e-24 (59/62) | | No putative conserved domains have been detected |
| 172 | 123629 | 123826 | MLKNIKKSDKLTRKDIQGFW GDEAKTLEEWYKSISKESDT DKMINTLKEYANNEFHFVK GEQGQ (SEQ ID NO: 302) | 65 | hypothetical protein EFP_gp129 [Enterococcus phage phiEF24C] | YP_001504238.1 | 1e-25 (60/70) | | No putative conserved domains have been detected |
| 173 | 123823 | 124128 | MTNTNNQQWNQKFNDGTM NQNNQQKEVITLQVAESFV SQILTKEYSVIGLVILMFYFM FGMFGIFGGAIYIAFTHTNRK IGAWQQVRSVYTIKEEQEE WNN (SEQ ID NO: 303) | 101 | No significant similarity found. | | | | No putative conserved domains have been detected |
| 174 | 124116 | 124307 | MEQIKGLTIRELIKKLEEVPE ENKDLPIYTFENENSLPIKGI SLYDENGKHSQENPLSFDVI R (SEQ ID NO: 304) | 63 | hypothetical protein EFP_gp130 [Enterococcus phage phiEF24C] | YP_001504239.1 | 8e-27 (61/63) | | No putative conserved domains have been detected |
| 175 | 124320 | 124679 | MNSFMNKQAKQVERSEKK LVEEVRRENVKKRFSEEVK KYLEKGYTIRLENKVFPFALI SIDLEKGEKVISLILVNEYDGI ANYTVMKKVTLREKGNRAIL KRMLTDKDVKVVSMWVKGI (SEQ ID NO: 305) | 119 | hypothetical protein EFP_gp131 [Enterococcus phage phiEF24C] | YP_001504240.1 | 8e-58 (114/119) | | No putative conserved domains have been detected |
| 176 | 125592 | 125858 | MKLKEFIKLAESKGATLEAY NELGGYELTRGDIVDQNPVL IAYMQGTHSVEISNEELENK ELTELAFVYKNASFIYPNEK ELLSGLGL (SEQ ID NO: 306) | 88 | hypothetical protein EFP_gp134 [Enterococcus phage phiEF24C] | YP_001504243.1 | 3e-40 (83/88) | | No putative conserved domains have been detected |
| 177 | 125956 | 126123 | MLEVGKFVRGNNGARTWV GQIVGIDRLAGEYRVRDVVT GIYFYVSCSAVYECARP (SEQ ID NO: 307) | 55 | hypothetical protein EFP_gp135 [Enterococcus phage phiEF24C] | YP_001504244.1 | 9e-24 (54/55) | | No putative conserved domains have been detected |

FIG. 5AO

| | | | | | |
|---|---|---|---|---|---|
| 178 | 126213 126339 | VDTVTDIIDVLGIIKQDJEYKG ERIKELEGQGKQEQAELLEA EVKGMREVVQDIEQAL (SEQ ID NO: 308) | hypothetical protein EFP_gp136 [Enterococcus phage phiEF24C] | YP_001504245.1 | 4e-18 (49/58) | No putative conserved domains have been detected |
| 179 | 126471 126647 | MNNNKLDELLEEEYSTLDEL LDSKEFKKQMNNLNHVPQM QPQSHNSNTLADTGRYPEK (SEQ ID NO: 309) | 58 | hypothetical protein EFP_gp137 [Enterococcus phage phiEF24C] | YP_001504246.1 | 3e-22 (52/53) | No putative conserved domains have been detected |
| 180 | 126728 126862 | MTIEQIINAEVKQQEMLGNKL EVIQLGNDIYMYINGEPYKTI ELI (SEQ ID NO: 310) | 44 | No significant similarity found. | | |
| 181 | 126943 127101 | MTIEQVKDYGKAYGKELSTK EVKEFFEKHNDMPSLMDLA KFCGAMNEDGTKN (SEQ ID NO: 311) | 52 | hypothetical protein EFP_gp141 [Enterococcus phage phiEF24C] | YP_001504250.1 | 2e-21 (50/52) | No putative conserved domains have been detected |
| 182 | 127235 127474 | MTPELAEMNLTKNDSPFSFI NESGVFIEPIKNPFSCEGTY LQACKDVAGELETNKEVGN EIDNYLKMQNWLNKLAYEYI (SEQ ID NO: 312) | 79 | hypothetical protein EFP_gp142 [Enterococcus phage phiEF24C] | YP_001504251.1 | 6e-37 (73/79) | No putative conserved domains have been detected |
| 183 | 127554 127778 | MKSIIIKQIIKDGYKGILERRN NGWADEELNSYTTGVSNTL FELINDLQDNGVISEEEAEEI EEVFSNTIDILNF (SEQ ID NO: 313) | 74 | hypothetical protein EFP_gp138 [Enterococcus phage phiEF24C] | YP_001504247.1 | 6e-17 (52/74) | No putative conserved domains have been detected |
| 184 | 127876 128571 | MTEWANMNKEEVLELLND WFGVSDYDTVMGELEEMIK KVTFTGSTNQPLLGGNNDLI GLPQFFKDNEAESELPTYEE LLEELEKDTWNLEAEDNTY NYSGFLESESDFKVIQAENS DTTIAFFAIHTGIDIRAGYSKA IPVIFETYYDFQEFLGNYFYS QGYYAFKHDNKEYTISLDVS ATSEYYRIYITDNNNNELQL DYEQETCMELDKESVAEYL TSQGIEFKDLKPAL (SEQ ID NO: 314) | 231 | hypothetical protein EFP_gp144 [Enterococcus phage phiEF24C] | YP_001504253.1 | 9e-110 (205/231) | No putative conserved domains have been detected |

FIG. 5AP

| | | | | | | |
|---|---|---|---|---|---|---|
| 185 | 128793 | 128987 | MSRKYRGFDTAFTKDGVGV YVIKDDKEKGTALVRDTRG GDEYTVSNEGMIYTKDMESI DVYMPW (SEQ ID NO: 315) | 64 | hypothetical protein EFP_gp146 [Enterococcus phage phiEF24C] | YP_001504255.1 | 1e-29 (64/64) | No putative conserved domains have been detected |
| 186 | 129086 | 129235 | MEINKAYERLLKEVELLQND LMDIEDYSNEGYVQAFQKVID ELEYVIEEG (SEQ ID NO: 316) | 49 | No significant similarity found. | | | |
| 187 | 129752 | 129525 | MLNSRGEPLLPINTQVRLNN FTFECNGRGRSPMGRVIGY DNSVCKEFTDYYIVESGDLQ GYAHYTNVIEVVLGGT (SEQ ID NO: 317) | 75 | hypothetical protein EFP_gp148 [Enterococcus phage phiEF24C] | YP_001504257.1 | 4e-35 (71/75) | No putative conserved domains have been detected |
| 188 | 129782 | 130054 | MLNIFYNVWGGFISHPVLITL SIVGIYVLGYALVKFIVGIVVL SNSLNTKWVIASAIFTTVLSI VFTIYSFLVEIYVVLVVISGLV VLLT (SEQ ID NO: 318) | 90 | hypothetical protein EFP_gp149 [Enterococcus phage phiEF24C] | YP_001504258.1 | 2e-38 (89/90) | No putative conserved domains have been detected |
| 189 | 130400 | 130059 | METTLIDKERLNKLKVGDTIF TKPELRDPILGCDKATVTSV TPGSVWMSLNGTEYEVHKD EKTKVPLYRNQSGEIVGEYF LDFADFHKYWTYFAKTMVE QVSLRGE (SEQ ID NO: 319) | 106 | hypothetical protein EFP_gp150 [Enterococcus phage phiEF24C] | YP_001504259.1 | 5e-51 (95/106) | No putative conserved domains have been detected |
| 190 | 130744 | 130433 | MDKNTKDELANALGKFGT LVLVLTLVIGGYVTMFLVIN GLIAPTFGVLTLTWAQAIGL DVFISFITAKTTNTEDSILM VFAKATVSTLLFMLIGWVVM FFI (SEQ ID NO: 320) | 103 | hypothetical protein EFP_gp151 [Enterococcus phage phiEF24C] | YP_001504260.1 | 5e-49 (102/103) | No putative conserved domains have been detected |
| 191 | 131000 | 130737 | MKYLIYATLVYYGLITLLTSYI LTYGYVWQLTNELSNPMPW FVIVLCGGIVLVLITAFIILVVN VIQLNKIENQEVNIAIIKEEND G (SEQ ID NO: 321) | 87 | hypothetical protein EFP_gp152 [Enterococcus phage phiEF24C] | YP_001504261.1 | 2e-39 (84/87) | No putative conserved domains have been detected |
| 192 | 131305 | 131001 | MAQCYHDQLTREEEKQLKR KYEVLQSGSCWHCNKPLW MYPPDRVVNLTTQLDLSIPN EYTVPTRLHYNPITGERMGL VIHVRCDYYLKELNNSLLNH SMEGK (SEQ ID NO: 322) | 101 | hypothetical protein EFP_gp153 [Enterococcus phage phiEF24C] | YP_001504262.1 | 9e-50 (95/101) | No putative conserved domains have been detected |

FIG. 5AQ

FIG. 5AR

| | | | | | | |
|---|---|---|---|---|---|---|
| 193 | 131716 | 131525 | MKLKDLIKLMKPGVDVLVTY PTAGATITVRTKIGSNNEVLE PYLDYEIANVSKTNHYIAIDII (SEQ ID NO: 323) | hypothetical protein EFP_gp154 [Enterococcus phage phiEF24C] | YP_001504263.1 | 5e-27 (60/63) | No putative conserved domains have been detected |
| 194 | 131984 | 131760 | MKVEQGELATLPQNPEENA TATIYFSVDDYGDIAITTGE EGYTQFDFNFTEEQWAVV DTISVQLRAQKLSS (SEQ ID NO: 324) | hypothetical protein EFP_gp155 [Enterococcus phage phiEF24C] | YP_001504264.1 | 1e-34 (73/74) | No putative conserved domains have been detected |
| 195 | 132249 | 131998 | MEKPYVAVRSIHTGRVEYC TEDWLFCGSERNAMPCKEI RYVDMLHCGMESYYEVTFK ANQYTYTEELPVYAFTGIKM IEKEES (SEQ ID NO: 325) | hypothetical protein EFP_gp156 [Enterococcus phage phiEF24C] | YP_001504265.1 | 6e-40 (77/82) | No putative conserved domains have been detected |
| 196 | 132630 | 132250 | MAKKVEIPSFVARAIKKYDS MLSLLANEYFDPYDEAPDD KLAEWIDEGNQYVLARAYM YGYTIKRQFKVIGDTRYDHG FTIGDTVYLEKYPDCVVAV RGNSRHSLKIVTLDVHFCDL EETIQEEE (SEQ ID NO: 326) | No significant similarity found. | | | Protein of unknown function (DUF1642) pfam07852 1e-05 |
| 197 | 133063 | 132866 | MGHLPDDVGSWATHCINLV CDGIELLEDKKSQTYTCEDC GEVVTLDELNEHLEKEAESY LKFFGYK (SEQ ID NO: 327) | hypothetical protein EFP_gp157 [Enterococcus phage phiEF24C] | YP_001504266.1 | 7e-29 (61/65) | No putative conserved domains have been detected |
| 198 | 133678 | 133063 | MDKNEFINLLGDEIFTQVGC DGTLNPHALGYNAGIAKAVS LAYGLDEPEKVVIPYKVGEYI DKCKEENLTFINMIDKGSYP SKMYFWLANNPENHEKLAK AWWLGHTVEEEEDEYYIIIAK DKDGVVGYSYIDRLGSPDFT NYLKDIPTFTEKEIRKMDER FMAFAVKVGDV (SEQ ID NO: 328) | hypothetical protein EFP_gp158 [Enterococcus phage phiEF24C] | YP_001504267.1 | 4e-82 (159/171) | Protein of unknown function (DUF1842) pfam07852 2e-10 |
| 199 | 133839 | 133591 | MSYEITYDSNTSVNIQEKIA VNNSALYKYCVEKKASRVN EKTEVKYTLEVSSAESQEST KLELPHEVMLRLSELIENSLE F (SEQ ID NO: 329) | hypothetical protein EFP_gp159 [Enterococcus phage phiEF24C] | YP_001504268.1 | 3e-37 (79/82) | No putative conserved domains have been detected |

| | | | | | | | |
|---|---|---|---|---|---|---|---|
| 200 | 134394 | MNKQELINALEELKFSHVPV VQELSNRSQCYNEAIKAAIL LAKKLDEPKKVVPKFVAEW YEGNKHALDLAIFTQIRMLD GNSYPHESEFDCWLDQSK NNPIETLIRMKDGYEVEKEP LYHIVFTGLGNKGEDCYLW VDKSHNNEVYFSNKPNMGK NKFTEQEIKEIDERYWAFAV PVYK (SEQ ID NO: 330) | 180 | hypothetical protein EFP_gp160 [Enterococcus phage phiEF24C] | YP_001504269.1 | 5e-83 (154/180) | | Protein of unknown function (DUF1642) | pfam07852 | 2e-19 |
| 201 | 134787 | 134395 | MIKFKEFDVGDIHYEEQIEK FQNEHPSAEFVTIT3GQTTY EKIWFKYTDDKVAQVELSD NQQIVLGWLKEKYTLTDIEPI ELFWRLRRANSIKPDYRNSPV YKNYRYMTEIAQLQVLQAFS QWAIERKERN (SEQ ID NO: 331) | 130 | hypothetical protein EFP_gp161 [Enterococcus phage phiEF24C] | YP_001504270.1 | 6e-69 (127/130) | | No putative conserved domains have been detected |
| 202 | 135140 | 134784 | MSRQRYNEIIDRVCYMYME ANGEINFPNSFEGDLLKIAY KTAVEAAVKKPELNIKNQKQV FEWLKYGYCSKDSLFEALE RIGETYEDPKTEEAYYSLSV TEEAQVIQAFTDWFLEQEG VQ (SEQ ID NO: 332) | 118 | hypothetical protein EFP_gp162 [Enterococcus phage phiEF24C] | YP_001504271.1 | 5e-61 (114/114) | | No putative conserved domains have been detected |
| 203 | 135314 | 135144 | MRKINVYIETTWAGIGEIETV EVPDNATNEEIDEVARDVFS SYCSFGWGDVEDEEE (SEQ ID NO: 333) | 56 | hypothetical protein EFP_gp163 [Enterococcus phage phiEF24C] | YP_001504272.1 | 1e-23 (55/56) | | No putative conserved domains have been detected |
| 204 | 135844 | 135302 | MDNKFATKDDRYLVQVIVN GEVKVSKTINGLAQAKAEKE RLTKHNRRNLVIDSEEYRDQ QNNLYGSRGGRHTVISINLQ KLNHQVEGNELNTIIFDLVSK LEVTHNLKJAPTYFKAVKEG RKLFEIRKNDRHYHVGDILLL NEYTCGSYTGEFVKAKVTYI TDYAQKDDYVVLGIIKLCEK (SEQ ID NO: 334) | 180 | hypothetical protein EFP_gp164 [Enterococcus phage phiEF24C] | YP_001504273.1 | 1e-91 (166/180) | | ASCH domain | pfam04266 | 0.001 |

FIG. 5AS

| | | | | | | |
|---|---|---|---|---|---|---|
| 205 | 136311 | MKYTCIKPFKTERVSVDVNS VWYGVDVNNMWYELDDPC YPDIKPKYILIGGSAGASIGI DLHTLLNNFMKVDNSYESV EIKLRERGIFGKEHTITFDYM GYAHFKQRFLKRFGNISSD RKLKKEIVNTNSLNDLERVF SNNDNWSIKIMKERY (SEQ ID NO: 335) | 154 | hypothetical protein EFP_gp165 [Enterococcus phage phiEF24C] | YP_001504274.1 | 4e-80 (144/154) | No putative conserved domains have been detected |
| 206 | 136778 | MVINRYILCIKSLSMEDMRY VVEKVSSKTDFGGGLSEDCLL PQLYRPITLVFVPSKKYYYQ SLGVTTYKDEKALVYSYGTD GDGLDQLLKDIIEEAKKVTTF EEGLKRRYNRQIKFKTKRIN NLLEQDKRGYGWHELGYLQ GVVTTLEDVLDDLEERQ (SEQ ID NO: 336) | 156 | No significant similarity found. | | | No putative conserved domains have been detected |
| 207 | 137345 | MSNCIEELLSKEAIYVDRFIV ARDNSYFANIVMQSFHTKN VFHVKRNDEYFMGIRANNF VVELGELDFEVPISKEDHEL LASVLGTKLDTATFVLVTGN HKGVRYTTIWAIPKTILDKEL L (SEQ ID NO: 337) | 121 | hypothetical protein EFP_gp167 [Enterococcus phage phiEF24C] | YP_001504276.1 | 7e-65 (120/121) | No putative conserved domains have been detected |
| 208 | 137521 | MIECLMCCVPLEETCGDFYL DEMLCGLCAAMHLLLDGIEQ SLMMEIYVSELLEEEENML (SEQ ID NO: 338) | 59 | hypothetical protein EFP_gp168 [Enterococcus phage phiEF24C] | YP_001504277.1 | 1e-23 (59/59) | No putative conserved domains have been detected |
| 209 | 138053 | MSKYILFWGHTPSKRNKLG KECLSQWYPSQFSAPIKGL GEDIIFPTAEHYMMVRKAML FNDVDTAKRILKTESPKDAK RLGRQVKNFEENLWVKHRK SIVLDGNTYKFTQNDSLRNF MLSIPKGTKFAEASPFDKVW GIGLRESDPRSRDTSKWEG LNILGEVLTEVRENLN 339 | 172 | hypothetical protein EFP_gp169 [Enterococcus phage phiEF24C] | YP_001504278.1 | 2e-95 (167/172) | Domain of unknown function (DUF1768) / pfam08719 / 9e-39 |

FIG. 5AT

| | | | | | |
|---|---|---|---|---|---|
| 210 | 138527 | 138054 | MIKVKVIDSDTPYGLSKELE KFLANHKHTSINYSVAYKNP STIYSALVTYKQEDVSVDSL VPLKAKGFLKIISFDKYRTLE ECHRFRVPLSTYKLNLNDGD KIPLFFKDKPVIAISPTGEEP YYFYEHPEHIEANGGLPSPH FAFEHKGNYYEYWEEH (SEQ ID NO: 340) | 157 | hypothetical protein EFP_gp170 [Enterococcus phage phiEF24C] | YP_001504279.1 | 4e-73 (136/157) | No putative conserved domains have been detected |
| 211 | 139231 | 138524 | MCFGYICPVCETAIVGDPDN GGELCQLTHIRHSKVIGTTR GHYNGLGGVWEDCYFGGR SGRNSQEEIFRSEYEFKDSY RIGKRRQAPSGREVRAYEP LNDLTVGSPERECFEIAIEGL NKELKGYANTILALEDELLQ SAIGGLSCMGGQDYYEKMMI LANMKSSSNRYWLVLSKLY NDYILTLPDSMEAKSGVIAV HVACLKTLSKEERASLPFSK PDPDQSIGTVREAYREDNT (SEQ ID NO: 341) | 235 | hypothetical protein EFP_gp171 [Enterococcus phage phiEF24C] | YP_001504280.1 | 3e-129 (225/235) | No putative conserved domains have been detected |
| 212 | 139700 | 139260 | VEFVEKAEYVFPKRILDFNL GHRVAIVLKEEELSCLERSY YKTRLYGSIYLVASDKISIEV YNESIKLGFNDEEVLGCVIG YPVECAKWFAKASREELSN SGVMMSGSYTFKCPEHLVD YAKEYMLEHYGLKAYYDIPC EKIVTFS (SEQ ID NO: 342) | 146 | hypothetical protein EFP_gp172 [Enterococcus phage phiEF24C] | YP_001504281.1 | 3e-78 (142/146) | No putative conserved domains have been detected |
| 213 | 139884 | 139750 | LNKQRENHKEKIKEHTEIIGH IEEKIENILYIPEEEEYNRDLP F (SEQ ID NO: 343) | 44 | hypothetical protein EFP_gp173 [Enterococcus phage phiEF24C] | YP_001504282.1 | 1e-14 (42/44) | No putative conserved domains have been detected |

FIG. 5AU

| Phage | Titer (pfu/ml) | Phage sensitivity (%) of EFS strains (n=105) | | | | | Total of infected strains (%) |
|---|---|---|---|---|---|---|---|
| | | ++++ | +++ | ++ | + | - | |
| F170/08 | 1x10$^{10}$ | 48 | 21 | 13 | 8 | 10 | 90 |
| | 1x10$^9$ | 43 | 26 | 8 | 7 | 16 | 84 |
| | 1x10$^7$ | 31 | 30 | 6 | 2 | 31 | 69 |
| | 1x10$^5$ | 55 | 1 | 1 | 0 | 43 | 57 |

FIG. 6A

| Phage | Titer (pfu/ml) | Phage sensitivity (%) of EFM strains (n=56) | | | | | Total of infected strains (%) |
|---|---|---|---|---|---|---|---|
| | | ++++ | +++ | ++ | + | - | |
| F170/08 | 1x10$^{10}$ | 2 | 8 | 14 | 14 | 62 | 38 |
| | 1x10$^9$ | 5 | 4 | 5 | 4 | 82 | 18 |
| | 1x10$^7$ | 0 | 2 | 7 | 2 | 89 | 11 |
| | 1x10$^5$ | 3 | 0 | 0 | 2 | 95 | 5 |

FIG. 6B

| orf | Start position | Stop position | Product aminoacidic sequence | Size (aa) | Homologous/similar proteins ||| Predicted function | Conserved Domains |||
|---|---|---|---|---|---|---|---|---|---|---|---|
| | | | | | Name[organism] | Acc No | E value and identity | | Name | Acc No | E value |
| 1 | <3 | 98 | GILLVDSQQALECCAL SSQWGSGNNGIHHQA (SEQ ID NO: 344) | 31 | No significant similarity found |||| | | |
| 2 | 100 | 528 | MQVDVPGKERISALSV RGTVLILDGQQEHDFAPI WDGGYLPPEAYIGRTP FQEIKVVDGDVFVRYIH QVTVEILDAEPGEVKP FKVTEDGPVEMPFEYY RLGLGTNSERSGDGE VPGSTEYGQEPSGES LPGGERADSDRIGS (SEQ ID NO: 345) | 142 | hypothetical protein [Pseudomonas aeruginosa] | BAB03223.1 | 1e-21 (51/94) | | No putative conserved domains have been detected || |
| | | | | | hypothetical protein PPF10_gp026 [Pseudomonas phage F10] | YP_001293370.1 | 0.14 (32/83) | | | | |
| 3 | 533 | 625 | MDKGEVADLTAWLEK VKEIQERYPLPEEPK (SEQ ID NO: 346) | 30 | hypothetical protein D3112p55 [Pseudomonas phage D3112] | NP_938262.1 | 6e-05 (15/20) | | No putative conserved domains have been detected || |
| 4 | 622 | 1146 | MTADQVFNQVLPEAY KLLPASMNSPEASVML LAIGLQESRFASRRQL VNSINSEGRKVLLPLG PAKGYWQMEKGGAVK GLLNFWKPATKELVHS VCKARGVPATQDAVW DALEHDDVLACALARIL LYTDPHRLPPKAQAE AWDLYLRQWRPGQPH EATWPELYRKAVRVVT Q (SEQ ID NO: )347 | 174 | hypothetical protein Daci_3261 [Delftia acidovorans SPH-1] | YP_001564284.1 | 9e-30 (85/179) | | No putative conserved domains have been detected || |

FIG. 8A

| | | | | | | |
|---|---|---|---|---|---|---|
| 5 | 1143 | 1655 | MTISARQIRWIAEVLLF AIIALYAYNKGPFVKAES KTNAEWELRMMQAER AAEENKKALEQSLLEA MNEVKKDADEQLADQ ASRIAAADAQ3R5LRE QVARLRDDLIADGARA STERHASNAASVVLAD LYGSCVSHRQELAGA LDRSHAAGLTCQKSY AIVKSLGHAPPQ (SEQ ID NO: 348) | hypothetical protein SPAB_01000 [Salmonella enterica subsp. enterica serovar Paratyphi B str. SPB7] | YP_001587255.1 | 1e-04 (51/165) | Protein of unknown function (DUF251 4) | pfam10721 | 1e-05 |
| | | | | Protein gp65 precursor [Phage Gifsy-1] | AAX65118.1 | 0.011 (47/166) | | | |
| 6 | 2275 | 1718 | MSKYEPVFDS8KVTR FYHVRGFAERNGRQV RFFKTTWVGFLETDR AYWVVDEDDLKELEH VVRIRKITAASDIRDLA KERYGAFLALKDG5TK RARTSVKAAFFSMICR REROLTFLERDLNFRA QSILLGTRLDTKVAER LEMLNTTTVEIPSSWDI DQQILAEHKRIHENEG HEEGALVWEPDF (SEQ ID NO: 349) | No significant similarity found | | | No putative conserved domains have been detected | | |
| 7 | 2459 | 2268 | MAEVITTVLEMPNTVIA TAVGDKIMEADAYRHY LESINVDPRFVLEEYIA MVAEKDQEWWKHV (SEQ ID NO: 350) | No significant similarity found | | | No putative conserved domains have been detected | | |
| 8 | 2826 | 2509 | MPWKSDPNIIWGVLSAI ALSVLSGVISLTSRIAK GHPPKFVWVVSELSS AILVGYLIYDVYPVIQH LLYEWMTMPICIAVGG HLGGRVFQWVEFKYK EKFGIPDSY (SEQ ID NO: 351) | No significant similarity found | | | No putative conserved domains have been detected | | |

FIG. 8B

| | | | | | | |
|---|---|---|---|---|---|---|
| 9 | 3134 | 2910 | MNYYLYLYLALGAAWFF VAIGHIFRVPSKQTVE RIITPPILISLSFFSTFM FYVFLWPLALLIDIWRR MIKKSTT (SEQ ID NO: 352) | 74 | No significant similarity found | | No putative conserved domains have been detected |
| 10 | 4960 | 3182 | MSNKVTVVGAVLDER YLTLYVKGSAEQIRIPQ GDPRVAVFVDKYPIL SQGGEVDYSEDLLVIN NVYEAAEKKSGGIMRF FRVAKKKVAEFFSAAS ASEPAAPVAPVTAGAV PGDCAPDTDAGQDVG EEVAEKVTIKDFPALAK AVDEILAHAVPASAPQ FSSVDLENLSEDGVES EDPDDDVGEGDTIIAV TDQGTIVPDAQIKLKTQ LTAAVQSKAKGSTVGI ENFLRRAGSVAAKRQ HSVQDLMRFIERGDLP I (SEQ ID NO: 353) | 592 | rIIB-like protein [Enterobacteria phage N4] | YP_9505121 | 2e-53 (158/441) | rIIB-like protein | No putative conserved domains have been detected |
| 11 | 7488 | 4972 | MQVTHQKDYATHVVI GGKQAISMGISDDPAF FQVLSSSLYTDKILAVV RETLCNAYDAHKMVGI EKETPVETLKDDEFVI RDFGPGIHPDDVGTTY GVYGGSTKKHDGSQT GGFGLQCKSPFAYYD NFQVTIHHEGKTNVYR MQKASIQNGGRPAITP VVTDIPTDQTGLEVRIN IKNEDVRRFGTLIRRIV ANAEMLANFNGVKLP TLPFSQVTEDWSIATE QVLEYNGHIICVRYGD VIYPVERDEFIAEVY (SEQ ID NO: 354) | 838 | rIIA-like protein [Enterobacteria phage N4] | YP_9505111 | 4e-61 (131/335) | rIIA-like protein | HATPase_c, Histidine kinase-, DNA gyrase B-, and HSP90-like ATPase | pfam02518 | 1e-05 |

FIG. 8C

FIG. 8D

| | | | | | | | |
|---|---|---|---|---|---|---|---|
| 12 | 7683 | MSLDGQTVAVHIVMFT NYFGYVPGKKQIDHLC GQRLCCNPAHLEMVT HLTNQKRRAKRAKSK E (SEQ ID NO: 355) | 63 | gp22 [Enterobacteria phage N4] | YP_950500.1 | 5e-18 (39/62) | No putative conserved domains have been detected |
| 13 | 8078 | MAKKAKLKADWTPGK LGHAPVNGRYFVNR ETRMTHTWTIGQLPVP EGYEQVTMQEYDSFR KFNGTLSKKKLMAFR GEAKCSKDAGKKSGS ESKPAAKSKTRASSST TSPAPATSGKARIQVR AGVVVTGG (SEQ ID NO: 356) | 132 | No significant similarity found | | | No putative conserved domains have been detected |
| 14 | 8221 | MIKHFGGIEEAEAAIAS GKAVYGKPTVPKGYIL GTDIKGMYYLHKE (SEQ ID NO: 357) | 46 | No significant similarity found | | | |
| 15 | 8822 | MNAAAFGLPATLREVS TVLKAPDPRSMKYRR LYMSIATNAAKQSVAE RHQVGGVLVTTTGAL FTGWNGTMPGTDNC CENGEYLREETRFKTT PYGVIHAEHNILAWAS RSGVPLDNSVLWITRA PCVRCAEMATHGVHL VLFRDDHDEPEGMTV LAMGNVKAMSWSTLD SLITEHGGHYVVSKTL LAN (SEQ ID NO: 358) | 189 | deoxycytidylate deaminase [Bacteroides vulgatus ATCC 8482] | YP_001299900.1 | 6e-15 (41/148) | deoxycytidylate deaminase |
| | | | | dCMP deaminase [Vibrio phage KVP40] | NP_899367.1 | 3e-11 (36/120) | Deoxycyt idylate deamina se domain cd01286 9e-20 |

| 16 | 11519 | MKYITWEEQDSYPVAI LIKEAAVSRSAAESTYI KQILEGLGVPRKNVIVI SLDYEGKKVSAKAIKE CIKDRDQLLRDLGVQY AYVADSKYFKEWTKR KTDADFGNLSPPAGY DPGYLVTPGVNHQVL LFDPGQMHRLSRGFK AIVDHAHGVYRPVGS DLLHDVTYIYRGHVSQ AKEALARLMDKPEISC DIEGFSLSMFDSGIATI GFAWNEHDAVQIQCD YREMIQDENKHHGYY EPNAEMREVLKWFFT EYPGR (SEQ ID NO: 359) | 871 | DNAP [Enterobacteria phage N4] | YP_950517.1 | 4e-175 (348/871) | DNA polymerase | DNA polymerase family A | pfam00476 | 2e-34 |
| 17 | 12046 | 11519 MQARTPEFLIFKRAVK DCLDGFLYVPVRKAF QAKLNELIIADAVARG DGIRAFCHRGRNFMIP GEKPNFRYFPRLSRG NRVLVDSLLSEYDPVLI DERDSVLTFISQVLNK SDEPSEYLKMFPSGL REPLKRVYEHFGLPVE GVEFPTESPIGSNQAG WDKLCTRVGINLVLGG L (SEQ ID NO: 360) | 175 | No significant similarity found | | | | | No putative conserved domains have been detected | |

FIG. 8E

| # | ID | Sequence | | Description | Accession | E-value | Annotation | COG | E-value |
|---|---|---|---|---|---|---|---|---|---|
| 18 | 13383 | MVDSPVQQEIELESPV RASDHVRSEGVDKPA PFVLTPGQEAGFQTFI NFYSNPDAQVMVLKG WSGTGKSTLIRRILDE METLDRALSTLDDNFE PFEPLLTATTNQACEA LAVAMKEPNHEVKTIH RALGLRLRTDYKTGKS ELMPISRFELPYRCLIV VDEASYIDPAILLQFCF DRTDCCKFIFVGDDC QLTPVGTNIMPAFAMK DIVVELIEVKRQNSGPL LDLCNAFRHTVKTGE WPKIQLDGDQLIHVPR D (SEQ ID NO: 361) | 445 | DNA helicase [Enterobacteria phage N4] | YP_950515.1 | 1e-38 (129/430) | DNA helicase | COG0507 | 2e-13 |
| 19 | 14531 | MTDRSAEDIALSKAKI RIIGDSKVSFYANIMM GLKYVWEEGMGTAAI DGITMFIDPKFFMSLD EMSRKTVILHEIEHVW RHHIGKVRMGDRDPM LYNIAGDHVMNNNLLAC GYGPISWTDYRTGAK CNWVCDPKYANMSTE DVYADLYQEQQTQGG GGLSSSTQGNSGSGN PVPFDDSRAPAKDD GTPMSETEIQGAINDLI LSAATAARANGNPGSI PGEVQVFIDSLMFPKL PLPHLLRQFFQVVKRG GFT (SEQ ID NO: 362) | 409 | gp25 [Enterobacteria phage N4] | YP_950503.1 | 4e-40 (115/386) | ATP-dependent exoDNAs e (exonuclease V) | | |
|   |   |   |   | metal-dependent peptidase [Clostridium acetobutylicum ATCC 824] | NP_348481.1 | 2e-09 (80/357) | peptidase | | |
|   |   |   |   |   |   |   | Uncharacterized protein conserved in bacteria | COG3864 | 3e-19 |

FIG. 8F

| | | | | | | |
|---|---|---|---|---|---|---|
| 20 | 15049 | 14531 | VSGRWELFMVRQEDL TGQAIVDEYANSDSPN RLLTGDFEGWRVSIYE KGIQKGIKFGTKSYLE KLASEFCPYVTVKPP DGSYVTPGLYVGHCR NSESQYNQSYSRLGG TAASINEVVELIRITNPL NGHWIFDEEEVFVAQ SLAVPSLIPETHNQVE WCKFAKAMAIIGGE (SEQ ID NO: 363) | 172 | No significant similarity found | | No putative conserved domains have been detected |
| 21 | 16131 | 15061 | MHFPQEQEVSIFDAKF IAESFLRAGLKPMIHG SPGIQKSAVARQIAKE NNLKLIDLRLTQMDPA DLNGLPNLSGERAKF QVFEQFPLVGDELPV NPETKEPFAGWLLFLD ELTSADDRQAAAYKL ILDRQIGNEDLHPKCL VMGAGNLETDGAIVN PMSSALISRLHHIVVR NDLKRWLQVVAPKLDI ATKVQAFLEFSPRAFY TFDPQNSGRVYACPR TWEDFSKWFLKMSPE QDPRALDDMLNLAAA MGIIG (SEQ ID NO: 364) | 356 | gp24 [Enterobacteria phage N4] | YP_950502.1 | 5e-51 (129/331) | ATPase | cd00009 | 2e-05 |
| | | | | | | | The AAA+ (ATPases associated with a wide variety of cellular activities) superfamily | | |
| 22 | 16404 | 16177 | MSKLQDLPVLIDRPGN YVTRDGSRVWIFTVTE RPEGYSMLTFDARGS YTRVNNTAKPECWHV SGRLHAFREHRKT (SEQ ID NO: 365) | 75 | hypothetical protein pQBR0228 [Pseudomonas fluorescens SBW25] | YP_001201975.1 | 1e-04 (27/68) | No putative conserved domains have been detected |

FIG. 8G

| | | | | | | |
|---|---|---|---|---|---|---|
| 23 | 17234 | VSQANEKTIERIGKILLI FKASEGEIRPHFWLTG PSGSGKSFNIMDQQN RLDIMLPMTEVNCASL TKEGYSGLSLSLSKALAP LATLGNVPNVVFCDE MDKLFLSGNSNDSHA NEISIGVQNEFLRVLE GSTTQTFGDYGKYNT VCVERSLFIFAGAFNG QENMDATELLKCGVK TEFIGRTGLVYNLEKP TLEAMVQYLKESELIW ANYRSLFPKEDHKKAE KWLIKEIGRQYPDSNI GVRLINTLIHQYYINAG ED (SEQ ID NO: 366) | 277 | ATP-dependent protease ATP-binding subunit [Helicobacter pylori Shi470] | YP_001910350.1 | 4e-12 (79/270) | ATP-dependent protease | ATPase family associated with various cellular activities (AAA). | pfam07724 | 1e-06 |
| 24 | 17478 | MQFSDLSPVEQKLYP THSSLKEALEEARHLL PGGSHHDFMRAMMG YHNTFLLFVGEWTPSE (SEQ ID NO: 367) | 61 | No significant similarity found | | | | | |
| 25 | 17720 | MSGDAIAMIVAYFATAI VAAGLFDFVLYDDYDD KADRSVTLGILWPIALP IVFGLTVTKIIKTAWKG FKDLCKYGIK (SEQ ID NO: 368) | 77 | No significant similarity found | | | | | |
| 26 | 18621 | MLSEERIEHELSSLKN VLDGLRRKITVLHNKR SILSEEIDTTERHVQSY VKRLEELDKEFFELRQ NQTIVHPDVQGQGQD EQITTAVLKDAVVTQM GNKLAEVLDALGFGKE HVQKHGLDETVYDAC LYVQSLKGGEALLNNL RSMLK (SEQ ID NO: 369) | 147 | No significant similarity found | | | No putative conserved domains have been detected | | |

FIG. 8H

| | | | | |
|---|---|---|---|---|
| 27 | 19199 | 18621 | MEKITWFQRGNPIDVP IDRCLYFLADGKLVQF AYHNDLGQLQIAFMTG ISVGKLYAALKGKFVY VRHGFIVANQRVGIKV GRSSHNIPIAVYVKGQ EHLCVQLTAGAKELVK AQFTGDHVLWSTKIKP GDTLVMLPGEPGERV RKKVVIEEIGTETHYN WCGHACFEIAVIDKHQ YRYTELNDHFQLYGV NK (SEQ ID NO: 370) | 192 | No significant similarity found | No putative conserved domains have been detected |
| 28 | 19226 | 19639 | MSLRQVLAGTEQEVRI VALLEVGVLPHDGMN QGVHGQFSIATALLAN LVLEPLDFLHGFGELL LQASIHRLEDCLFRDD LGSSFRLHGERLGEF GDLLVACFDGRLQLA DLGLQAIIIALSTRVDP TVVLGFRECCV (SEQ ID NO: 371) | 137 | No significant similarity found | No putative conserved domains have been detected |
| 29 | 20325 | 19750 | MHTFEPGDPMTVIHD SFEHDSTEGLEAELR AFGAMWWLRGETSW WSRFRQAEERPEHVM YYDIANFIMENDFLIQN VGKRFKLQDEEEFLE MLRKLVEEAMERDSQ YRNKPVARSVLHQAS VLAMDWVRVGYRAAR RKYPDNFAVADLMYY LYERVRYISHDAYEGS TLQLKYTLNGKYVQVY LDGELR (SEQ ID NO: 372) | 191 | No significant similarity found | No putative conserved domains have been detected |

FIG. 8I

| | | | | | | | |
|---|---|---|---|---|---|---|---|
| 30 | 20604 | MRKSYLKFLDTMAWIV AVLVFVVAVASLTVY NGLVALFVMLGAAVGI GMTFGRWFLGYGIYE ELQKLNARVRA (SEQ ID NO: 373) | 74 | No significant similarity found | | | |
| 31 | 22168 | MTPYTAFEYLLIDAAN QMGHDKWLFEQRIQ WCYDNFDDLENLECN EKTRPQYLKAVMAIRA AQRGEPVGHLVGLDA CCSGMQIMSALGGCE SGAQATNLINTGFRQD AYSLVTTAASTHLGES VQEIKRSDIKTATMTH FYGSKAEPKNLFGEDT PELEAFYQGQVEMVAPI ANEMRDDLINTWQPY AMKHSWVLPDNFHSI VKSVDVFETRVEVDE MEGASFEYIYKQDCG VERAVKNAANVHSID AYVLRSMH (SEQ ID NO: 374) | 413 | RNAP2 [Enterobacteria phage N4] | YP_950494.1 | 4e-51 (137/419) | RNA polymerase 2 | T3/T7-like RNA polymerase | PHA00452 | 2e-16 |
| 32 | 22475 | MNVAAWLHNGEWHL FTDEMNRVVSDQAYY QAQLKGPDKRDLVLL RMTAKRRNTAYWFHF RKDNPFNKYMPVAYT EEIPKELQALLTTYGL (SEQ ID NO: 375) | 90 | No significant similarity found | | | No putative conserved domains have been detected |
| 33 | 22763 | MELVVWKDGDNWRV FADDAVPALDGTVDR VAEGLATLYRKEKEPV VFTRRKTAFVDGQYW LMWKYPTYGRAYGK EASDEMIKEPSAIALLA GY (SEQ ID NO: 376) | 94 | No significant similarity found | | | No putative conserved domains have been detected |

FIG. 8J

| | | | | | | |
|---|---|---|---|---|---|---|
| 34 | 23058 | 22798 | VSHYAFYKEDDTWKF VKYGGILLELVQAASM MAYSPKEAAACTCYK LNGVRMMMMGMTDK DAIEDVNLLPADLRAM LVIWSLDQLLE (SEQ ID NO: 377) | 85 | No significant similarity found | No putative conserved domains have been detected |
| 35 | 24003 | 23071 | MTITHMLPEDMQRAN EYRFARAHIDGYIREFI RGDEDLPALMERGIAL LEEYRTTEYSYNSKNL RMETVRNLDLEHIVFEI IVASAYCQVPDMFISF TAKLAGVLGFDDKADS IKTAEMVAVLAELDVY DIEQVYKYGTYKVISNI QLPEKLQHAVERAMY LPPMVCKPSKLTGNK SKLHLTLEKESLILNNN HHNEDICLDVLDKMNA VELCLNTEFLSTVEEE SHKYLDTQDKKDDWY RFVSESHEMYKLMV (SEQ ID NO: 378) | 310 | RNAP1 [Enterobacteria phage N4] | YP_950493.1 | 5e-23 (63/197) | RNA polymerase 1 | T3/T7-like RNA polymerase | PHA00452 | 0.001 |
| 36 | 24362 | 24015 | MRINAHNKDMFTMVGI REAEQNMARKFNTMLI SDSLRKGESCLYIFDG LTEEVFRKDLSNVASG LMMSRLKSYTDPFFKL YTKHNGRWFVFSSDF NPVAEKLVPPEIRAQS LLFD (SEQ ID NO: 379) | 115 | No significant similarity found | No putative conserved domains have been detected |

FIG. 8K

| | | | | | | |
|---|---|---|---|---|---|---|
| 37 | 24842 | 24402 | MPQFVVGNMWEAFD KADHFIVLSNSTLTST GAVVMTAGMAAELVA RFHDAGIQTSVGQYIA ENGGAGGIFGCRCQS KVGVFQDKRHYRDPT DLGCVSTSTTQLMWR AQENPTHQYHLEQPG QNEPWWLIKDILARLP GNVTIWSRP (SEQ ID NO: 380) | 146 | No significant similarity found | No putative conserved domains have been detected |
| 38 | 25093 | 24842 | MTRTYLKRVVIRDDNG MFVSDGDTLIDALREV KLKNLLKQLTVIDQDD GHRWMFQYSHVNNHI VLTKQSPDCCDGIIRM GDLL (SEQ ID NO: 381) | 83 | No significant similarity found | No putative conserved domains have been detected |
| 39 | 25494 | 25093 | METNHIMIFVFGSNTA GHGAGAALYARNNK GAEMGVGEGPTGMS YALPTKYRAHGGRLVT CHISDVAKAVQRFMDF AKEHSYMSFQVTRIGC GLAGFHDSDIAPLFQA APDNCYFSEAWKPWL KPTTKYWGNE (SEQ ID NO: 382) | 133 | gp14 [Enterobacteria phage N4] | YP_950492.1 | 3e-23 (59/125) | Hypothetical protein | PHA00684 | 9e-24 |
| 40 | 25787 | 25494 | MPTDLKTPTGGTVTG RLVVDRDYLNKLLEVR KYSDRKIDMVYIDMTA LEERVMAHMLDQIPKP VKKSKRRPKWEMPVR NHETNHLGKGPRNKF GGFN (SEQ ID NO: 383) | 97 | No significant similarity found | No putative conserved domains have been detected |

FIG. 8L

| | | | | |
|---|---|---|---|---|
| 41 | 26262 | 25972 | MALKKSNARTNTAAQ SDDTRAASFINISIGTR GGDPVRLGNGIPLRLS EAVEAQLHEYLAEAKD DKDLAKRIENLRSRLIL SFRVVRDKSELQLDL (SEQ ID NO: 384) | 96 | No significant similarity found |
| 42 | 26541 | 26356 | MIVLITRKATSILDRGY RECLDAESVARELHAI GMSAVTEEDVLNHWA DWDNDLSDEPRWV (SEQ ID NO: 385) | 61 | No significant similarity found |
| 43 | 26835 | 26614 | VTDVEILNLLCLYIASS VAVLNGYMKWSSNNY TMQQTVMGLVIDILVM HVLTFSGMFALIGAVCI FFNLVGLL (SEQ ID NO: 386) | 73 | No significant similarity found |
| 44 | 27085 | 26832 | VILIMFLLFAVGLSMLV IGLHRQWVINEMLRFP LSISRRHDLEMRRIHA WVMAVCGLGLLFAGC GPLFIFLAGGIL (SEQ ID NO: 387) | 77 | No putative conserved domains have been detected<br>No significant similarity found |
| 45 | 27280 | 27062 | MTIVQLLAVIAVLLLVV PTVLSFLRMLVWAAET VWRCETGRGNRGTA AVATVLYGVATWVCA YLFFVVGAYL (SEQ ID NO: 388) | 72 | No significant similarity found |
| 46 | 27503 | 27300 | MLTIACIVLIVFCGYLFL VKCLASLTCFGALFVL PGAEKVAAVVGLVWN VFWAAVWVTAINFLFH VA (SEQ ID NO: 389) | 67 | No significant similarity found |

FIG. 8M

| | | | | |
|---|---|---|---|---|
| 47 | 27803 | 27507 | MSTNLNLTGRLFDIKI PTNGKLTGFRVRMTLF NMDCPNTVLTHVVMC GDEYTAKSLKTAILQR RRLNLKHMHWTEVNK DLPGACTNRLKTKPFT LEI (SEQ ID NO: 390) | 98 | No significant similarity found |
| 48 | 28095 | 27787 | MRTIAELIKIGLEWQQA NRGETYMCFVLSDLA NGVVVGPPITWDEYR SFKNWLWEKLHFRGS DSYLGLLERVGLDDSE ENWVQFYAWAYYDLI KRNTYEHQP (SEQ ID NO: 391) | 102 | No significant similarity found | No putative conserved domains have been detected |
| 49 | 28350 | 28099 | MMYKYARIKRVRNITV YDIACQCWARDFQYD QCLFLLIQHGFSPIQSL EEFQRVWNMLDQAFA DFCNERGCPADPIGFA DVRI (SEQ ID NO: 392) | 83 | No significant similarity found | No putative conserved domains have been detected |
| 50 | 28692 | 28350 | MNTLYHKMQEHVCFV GFTRDGVNYQTNRVR TFGEARHFITFNCSPS DKDIRIFYRIPHEGAED VEVVIARLDLTETKEN N (SEQ ID NO: 393) | 80 | No significant similarity found | No putative conserved domains have been detected |
| 51 | 28819 | 28589 | MSNPHSVFRVAIKCFV RMVTNGELITSPTTHNL EEMRDYNRNNCKPTD TGIRLSYMSETEGCEV VLARFDHNGKVLV (SEQ ID NO: 394) | 76 | No significant similarity found | No putative conserved domains have been detected |
| 52 | 29025 | 28834 | MDQMIYTLLYTNECLH SIEHEFEAVSDEVARIK ATAMCRGQEGLWSGI YLTDPQGEAITFDPF (SEQ ID NO: 395) | 63 | No significant similarity found | |

FIG. 8N

| | | | | |
|---|---|---|---|---|
| 53 | 29726 | MFKALNQFFAMLESM FRAVTNLTKAAENVTE WAEEESAHFNNKARL QREQAIAALLNIENAQEL QEKGLTEAVESVRKE RTKAKA (SEQ ID NO: 395) | 84 | No significant similarity found | No putative conserved domains have been detected |
| 54 | 29750 | 29472 | 35 | No significant similarity found | |
| | | 29867 | | | |
| 55 | 30797 | MVVVTQDQSTAQPKA SLDLEVQTDDWVEVE LNKVG (SEQ ID NO: 397) MNNKAVLNIKLPGQEL VEIDLGISWHEYINNA GDDNTGLVYVKLAEY AELFDVVPNNPAEKKI AELEAKVKELEDKLKA TSTEENRESFLCRVA5 RGSRKQADIVKKDGLF YWWGTIRGTTLRMEST FMDADFDPVLRDARD WWKTPTVMSGGLGVL VMSDRARNHRLELYW FAATGLFTGVATHTET GLAYVSPVKHRDWKD AWREIGCYIQGKD (SEQ ID NO: 398) | 216 | No significant similarity found | No putative conserved domains have been detected |
| | | 30147 | | | |
| 56 | 31309 | MELNDTGKIRIVLTIQG KAYYLDALLTRDEWDT MTDAQKTKYMNEWVL ASVSIRPQMPSSESDI LKHKIHELELEVSRLKK QATPTFRYPPGVTIGH LPDQR (SEQ ID NO: 399) | 102 | No significant similarity found | No putative conserved domains have been detected |
| | | 31001 | | | |
| 57 | 31560 | MKADWVSNLIFALVW SLYVPKPASEEHLWLF HLLHFLFALLLWTAIDV TRYSPEWKEKPVFAF FIFAPMVPMNLYGAM MLLELLWN (SEQ ID NO: 400) | 86 | No significant similarity found | No putative conserved domains have been detected |
| | | 31300 | | | |

FIG. 80

| | | | | | |
|---|---|---|---|---|---|
| 58 | 31769 | 31557 | MDISYAHVQMKLKNG KTTSHKVEIPYSLSEV QDDFYSTVAQILNLVR RGTGISVLNVTHSRVL FTAGPNQ (SEQ ID NO: 401) | 70 | No significant similarity found | |
| 59 | 32200 | 31769 | MQLEPYARHIVNGEL MSRNARVECGTKVFL LRDTLTHNPDTGRKLA LGAGSQVVMGLCIQY TEKGNIPLIAVHSINED GDLFHALVDPNHLCYA ECPVDRVLKLVQVEE MTVMLRNKGYEQSEK VAELLYSYGIHQLQEG KL (SEQ ID NO: 402) | 143 | No significant similarity found | No putative conserved domains have been detected |
| 60 | 32722 | 32333 | MVDRLLLDVSIEHMA WDQCLFQDEVHQLRL VVAGDVAGHVLVGHT LLGPPLDLGGEGTGV SLGVVQPHQLIGHVLR SMEVVVQLELTFLHH MGVPNDVVPEGFRHV RIGQHVIECLQYFRGD GLLHLVR (SEQ ID NO: 403) | 129 | No significant similarity found | No putative conserved domains have been detected |
| 61 | 32735 | 32992 | MQNAQSEKVQQESAN SILTHLKSPEKTELKID VSDRAADAIDIMRQNA EALARLQQEMIAGKQL SAKDVAERSMDFGEVI EGELA (SEQ ID NO: 404) | 85 | gp69 [Enterobacteria phage N4] | YP_950547.1 | 0,050 (26777) | No putative conserved domains have been detected |

FIG. 8P

| | | | | | | | |
|---|---|---|---|---|---|---|---|
| 62 | 32992 | MNLDATPIAKAVADEV DFAGLDEAAKSVEQW LREVVYGDDSSYIPSIF ALQFVDFIKMVNGNEG EENKTPVLHLRMLDQI GSGQTRJANMVFRGA AKTTVMGEYLFLYIALY GELPGFGKVDLALYVS DSIDNGVKNMRKNLEF RWENSEFLKKYIFQTN FTDIRWKFTNLDGKVF IVKGYGAKTGVRGAKE MGKRPQLAVLDDLVS DEDARSPTVIAAIEDTV YKAVDYALHPKKNMII WSGTPFFNAKDPLYKA (SEQ ID NO: 405) | 34644 | 550 | gp68 [Enterobacteria phage N4] | YP_950546.1 | 5e-157 (282/527) | | Terminase-like family | pfam03237 | 0.003 |
| 63 | 34641 | MTIQLKQVIDILAEGEL SNIKYVNIDTGALVLER VPSLIRAINLGVLDLHK RFLLKEGMLKIQLEEG RRLYPLRPAYQVGQK PKPGVPQFITDGNKLG RQSILKIEKIIGDNGVE YYLNDTWQPLNITTPE FDVLEISEEFYCHSSS KTLEVRYRAPTPMKI CVDNLDSWGCIDIDLP YTHLQALLYFVASRCQ TPIGFMENTAQDGFNF SQKYEAECAMLDAQN LRIDPVGNQDRFTRG GVV (SEQ ID NO: 406) | 35375 | 244 | 30 kDa protein [Enterobacteria phage N4] | YP_950545.1 | 5e-10 (85/236) | No putative conserved domains have been detected |

FIG. 8Q

| | | | | | | | | |
|---|---|---|---|---|---|---|---|---|
| 64 | 35707 | MQLIKEYEHAQPLKFK GWQVSEDHEQNVQA LQEMLGSFPFITAAFG DNADGERVYSLSNFN EGATLDVKAGEMFVN EEGSIEGWSAEVGAV RFKEIQA (SEQ ID NO: 407) | 99 | No significant similarity found | | | No putative conserved domains have been detected | |
| 65 | 36097 | MPVRASDTAGGYDIF MPEGGVAYPNQPTKV KLGFSAAVPEGHVALL LPRSGTGSKAGLRLR NTCGVIDSDYRGEVW AVVSTDREPFHWEAG NRVLQMLLVPVATPEL QLVEELSETNRGDGG FGSTGE (SEQ ID NO: 408) | 128 | hypothetical protein COLSTE_02170 [Collinsella stercoris DSM 13279] | ZP_03298245.1 | 4e-19 (59/128) | dUTPase | dUTPase [nucleotid e transport and metabolis m] | COG0756 | 1e-29 |
| | | MADVDEDYLTLPNED GDPSKRLQPEWSNAP SLAQLKQDYQEAKQV TDEKITQINRWLDYMH VRGEGKPKTEKGKSA VQPPTIRKQAEWRYS SLSEPFLSSPNIFEVNP VTWEDAESARQNGLV LNQQFNTKLNKQRFID EYVRAGVDEGTIIVKV GWNYQSRTVKEQVVT YEMMPDSSEELAQIY QTAAQIREESPSGEYPE IPEDVRLGLEETEANGI QVRAVPVGSEEEERE ETVENHPTAQVCDYN NIVIDPS (SEQ ID NO: 409) | | 94 kDa protein [Enterobacteria phage N4] | YP_950537.1 | 0,0 (345/706) | portal protein | | |
| 66 | 36165 | | 726 | putative portal protein [Burkholderia multivorans CGD2M] | ZP_03572553.1 | 8e-09 (146/671) | | No putative conserved domains have been detected | |

FIG. 8R

| | | | | | |
|---|---|---|---|---|---|
| G7 | 38415 | 38753 | MNEEHAIQITRKNAEK FVRLRDAMLRLHKNR DFQALILNDFLKDNAA RLVLLKADKNMESPE MQARIIREIDAVGALHT YFQLIGVRGDEAEQAI KDCDAELERVREEED EE (SEQ ID NO: 410) | 112 | No significant similarity found | No putative conserved domains have been detected |
| G8 | 38753 | 39949 | MADFLEMSDDDLPEF YEVEEQTRSDQEEPE QEQQNDEQSEEVVQE EEPADEEQEEEQEEE QDPLNSPDDELGDLP VEEKPTEEESEQEEEE EDGDKEESEETPTEE KPEAKKSEATKQEVD PADFMAKITAPPFKANG RDLQVKTPEEAIRLMQ MGANYNHKMSALKPN LHMMRQLDDAGLLNP DTIANVVDLLKHKPE AIAKLAKDAGVDPLDL DEKSVADYKPTAVPFN QVREALDEQLDSIEHS PSYNRVVT (SEQ ID NO: 411) | 398 | gp57 [Enterobacteria phage N4] YP_950535.1 | 8e-34 (91/270) No putative conserved domains have been detected |

FIG. 8S

| | | | | | |
|---|---|---|---|---|---|
| 69 | 39984 | MAGPVDNIKPMKYND PANGVESSIGPQIHTR YWYKRALIDAAKEAYF GQLADTFSMPKHYGK EIVRLHYIPLLDDRNVN DQGIDASGATIANGNL YGSSRDVGNITAKMPT LTEIGGRVNRVGFKRV EIKGKLEKYGFFREYT QEQLDFDSDPAMEGH VTTEMVKGANEITEDL LQIDLLNSAGTVRYPG AATSDAEVDASTEVTY DSLMRLRLDLDNARA PTKIKMITGTRMIDTRT VGNARALYVGSDLVP TI (SEQ ID NO: 412) | 399 | major coat protein [Enterobacteria phage N4] | YP_950534.1 | 2e-121 (218/400) | major coat protein | No putative conserved domains have been detected |
| 70 | 41240 | MSLDELQNLSEAPLES PDTRSELEVLQEKATA LGISFRSNTGVEKLRE KINAVLNDEAVGDEEE DEATEATSSIPKPSAE AGAAALKAAEAPRPKT EGELRRDRRLAAHRLI RGRITCHNPNIKNDWD AEYFSIGNDEIGTIRRL VPYEVDWHVPEALLN FIKSKQYQIHFYTVTEQ TPMGPQKVRRSKSVR EFSVEILPQLSEDELES LRKQQAVNGSYKED (SEQ ID NO: 413) | 221 | gp55 [Enterobacteria phage N4] | YP_950533.1 | 2e-19 (63/200) | | No putative conserved domains have been detected |

FIG. 8T

| | | | | | | |
|---|---|---|---|---|---|---|
| 71 | 41909 | 42874 | MAVEPITIADLTEVKLD GKGALDQLLQVTRLHL AKEHDAGRLKGQEYA AVLTGGITAVLQNAVM FLLQKDEAANKAALVE AQIKLTEKQGELLDKQI AQADKDAELIAAKVKL TLEQAKLPDSQIRSAG FQDLLVQEQTKVQTA QTRRIDQEILSAGFQD LLVKEQTAKTKQDVLT AVQQTKVMEQQVLES TQKVLNMKQELLNLVA QECLLKAQFDLTKDQ GLNTQEQTILVRQKVA SERAQTIGAGVDADSV I (SEQ ID NO: 414) | 321 | gp54 [Enterobacteria phage N4] | YP_9505322.1 | 2e-11 (84/298) | | No putative conserved domains have been detected |
| 72 | 42932 | 45154 | MGLFSSKKKTVVNTTV QRVFDDAHIPDSPRTG VIQGITHETGIVENILEK LSDSIGVRANTAYLWA QRNNYWGLPESKVV NGVDARTVVVQTIARS EGTITYYNQFGFLNS LHWGFTELVRLYQYN PLTNELPGLSTTKGSK VYLFDMIPVFQTDTVA WADETANKGMLQDFG FSPKSGYTPSRPYNTI GGMGQFAGWSPYRT DNSFGEEDYVLLTYEW KDAQGVIKQETIRMIM NLDLSLDYHQVRFRR QNGT (SEQ ID NO: 415) | 740 | gp53 [Enterobacteria phage N4] | YP_9505331.1 | 1e-10 (119/562) | | No putative conserved domains have been detected |

FIG. 8U

| | | | | |
|---|---|---|---|---|
| 73 | 45135 | 45602 | MAYPYSDMPFGVELD TSTLGSFGLGGPQTQ LQMQMPAVDVNAAAS GSGGFMSGFSNIFSR DSMFGGVAPSGAQTG GWVMPALGIGQAVFG AIGANRQQRAARDQL AESRRQFDMNYGAQR QSINTNLEDRQRARVA SNPTAYESVDSYMER NRIR (SEQ ID NO: 416) | 155 | No significant similarity found | No putative conserved domains have been detected |
| 74 | 45602 | 47167 | MAQEITWRNIGATVSP GSASSMSAGTTGVQQ ALGALGDIISRQQEMN VNNAKLQREANTQSY LDQVAASTLEQLSNAD YRSGLEAQRDAMGM NLDRAATRDAITKQISA QQNQAAATQKFDDM QAEVGQRGIVDQLRTL AAEGRAGEVNQILAEQ QLINEGEIRKELTGVQ DAIQNRQYRAAGEQR AQAAANRAAEAHSLS MAAGRENLAFTREQR DELRRDRDEAKLVSG TIATTFQDYDESRQAQ SEIMRIVG (SEQ ID NO: 417) | 521 | No significant similarity found | |

FIG. 8V

| | | | | | | | |
|---|---|---|---|---|---|---|---|
| 75 | 47168 | MADFDLDQFLSDRQE ANAGATPAFDALDFAS AGLDMKGSQKAYDLD GIRERKKRNVEESLIG KMGITPGAAGTEILNT AASFVSGTGRALGDVI ALPINAAADMGOAGVT NEAIEAYNRYVSAQM QEGDEAILSQTAAGDD GVPQITMLQRMQGVD ELRKFSTNVDKFFDW SSIVDTTRRDQLSDDI ADATAGGVERLRNAG ESFSRGEILDGLVQGA LGVGQTAATAIGASAT NPLAVGEYTVENAPQI LAYAAN (SEQ ID NO: 418) | 3398 | virion RNA polymerase [Enterobacteria phage N4] | YP_950528.1 | 3e-38 (238/1065) | RNA polymerase | PRK09510 | 6e-04 | Cell envelope integrity inner membrane protein TolA |
| 76 | 57583 | MGVLKGLFGAGALAG AVIGILFIGFVFSWMFRI LGVVVALFIVLILLCVW GWEWLKYCFSRKKEG EQ (SEQ ID NO: 419) | 67 | No significant similarity found | | | | No putative conserved domains have been detected |
| 77 | 57910 | MSLVDAVVEAKRQGV QHSLRGSNYESDIPPS LKALLDEALRLANEHSI PLYWSASLPNGVMTR AALGEKGENIHIQYLM SYAAAVQDPALAQEV VQKGMAFLDKK (SEQ ID NO: 420) | 105 | No significant similarity found | | | | No putative conserved domains have been detected |
| 78 | 58143 | MGDLSKACMLKNMHV TRVLHLIEMRNKLTNT LRDNATDDGMATLEM FDAALKQETDRFLRAL RAVGNENINEIKKAAE (SEQ ID NO: 421) | 78 | No significant similarity found | | | | No putative conserved domains have been detected |

FIG. 8W

| | | | | | |
|---|---|---|---|---|---|
| 79 | 58142 | MAKFLLVGCKGWSAL VWTPLRGGGCTRCN GPEHSLMPTGSIDIRK PAGGSWLGLQRHQLR EVVNGPLDLGGQGGL GSGIQGPMRW (SEQ ID NO: 422) | 85 | No significant similarity found | | | No putative conserved domains have been detected |
| 80 | 58444 | MAVNTKKSPPTRNHY ENFRKGMKVVTYQRT KGNTLFTVDCDPVEVA DLHAC (SEQ ID NO: 423) | 51 | No significant similarity found | | | |
| 81 | 58954 | MKAKSYYLLAFAAPTG VGTVFQSAIHAFEQGK SHDFTVPLIAQIKERSG IGANSIMLSVSFLGTM TEAEFNPPFRPGMDA TVAYLEGVRAGLENSE KDNPYPTGSVEAADY RNGRISGFSMREGQQ PPQDHSPQ (SEQ ID NO: 424) | 134 | PmgR [Enterobacteria phage P1] | YP_008558.1 | 0.059 (22/66) | morphogenetic function |
| 82 | 59449 | MKIELQQAEVAAGIAT YLTANGLKADASQLSI SFQTTRKGDGGIVAFV EVPELAVASLVGTKAP VATEPQTVEVEKPKK AEKKVVNTEAAAGLAT AVAESKASEAAPVEVA TEEPEPATEMEAKEEE PVAEQAAPASTGGSL FS (SEQ ID NO: 425) | 145 | No significant similarity found | | | No putative conserved domains have been detected |

FIG. 8X

| | | | | | | |
|---|---|---|---|---|---|---|
| 83 | 60021 | MARLNVIGMDPSMSN WGLACGQYDTTSNTL SLRHIEVIQTSKTKDKQ IRVNSDDLNRSTEITTR VMEVIKEANVIFVEVPV GSQSAAAMKSYGMCI GILSAVRASGKPFHLL TPTDLKVMAGNSKTAS KEAMIEWAVKKYPHLN WPRTSKGEVIA8RAE HMADACAAAEYGVFH HNDFKLALAMLT (SEQ ID NO: 426) | 59461 | gp46 [Enterobacteria phage N4] | YP_950524.1 | 3e-36 (79/171) | No putative conserved domains have been detected |
| 84 | 60452 | MKVNPQDVKNMIVEE SFTILPSGLTTVCQLTL VNGWTVTGQSSCVDP IEFDAEIGKEVARRNA EDEVWKFAGYELMQK LHKQNMGPKERLKLE LDELLKARQESLYSFLR SDAAASVHAYMGSLL VQQKDVQNNLIEHLEE RLQQWQD (SEQ ID NO: 427) | 60009 | hypothetical protein RSL1_gp284 [Ralstonia phage RSL1] | YP_001950159.1 | 2e-15 (35/81) | Hypothetical protein | PHA01971 | 3e-17 |
| 85 | 60814 | MKVRELLDSLKRQLSY CTNPQQRERLLDHTL RIPVLRPGTVGARPSV DVLSVVPGFDWDDGS MFCEIPNSDIKLTVLTP EEVKTIMASYSKGTSW FAYQETKKLREEINRL KKQLELLGGSE (SEQ ID NO: 428) | 60449 | hypothetical protein P91278ORF_144 [Photobacterium damselae subsp. piscicida] | YP_908742.1 | 1e-13 (40/91) | No putative conserved domains have been detected |

FIG. 8Y

| | | | | | |
|---|---|---|---|---|---|
| 86 | 61564 | MFQNLSTSNNSDIKEA KDSIGGGSRIFDTDIYA FKILAAYGSESSGQAL AVNFEFEHGTGRKL KIQQYVTSSKEKGQN NYYVNAEGEKHYLPG FNIVNAICLMTAEKELA ACVPEQRTLKIYDYDA KAEVPKQVPVLADLTG KDIYLALEKIENKRVK NEATGQYEDSSETRE LNDVAAVFHFGTKKTL NEARAKAEPEFFDKW KEAKAGTVFDKTKKV AGGGAASGRPAPAGG QAGGGKPASLFS (SEQ ID NO: 429) | 248 | single-stranded DNA-binding protein [Enterobacteria phage N4] | YP_950523.1 | 2e-25 (87/263) | ssDNA binding protein | No putative conserved domains have been detected |
| 87 | 62325 | MTQVNDHLVLVSGLS ATGKSACLRNLREPEK VIYLNCEAGKRLPFKS RFIERTVTDPYQIPTVF DAVVEGKVEAHTIIIDT LTYLLDMYESQYIYRA ANGGAAWMDFQQFF KDLMQQKVASSPCKVI FLAHTKEEYNKATMA MDVCVPVKGALKNNG IESYFSTVISTKKVELG KLEPFKENNKLLEITPQ EEMLGYKHVFQTQITK ETVGERIRGPMGMWT HEQTFIDNDIQKVLDH LDWYN (SEQ ID NO: 430) | 244 | gp44 [Enterobacteria phage N4] | YP_950522.1 | 2e-73 (131/242) | | No putative conserved domains have been detected |

FIG. 8Z

| 88 | 64542 | MLKYEEMQHHPTSERI VEILCEKTQSKNHRFF RILVGFQFSMMAAHM RCHIKTHERGEIPVNM YALNLMPSGAGKGFS TKVMEDQITYGFRHRF METFDTAAEKHLDDLA FKRHIRKGSELPDEQE AVRKEFKSLGPLLYDF DSGTQPAVKQMRHKL LMANAGAVNLVVDEIG LNLPAMTEIMPTFLELF DVGSVKQKLVKNTND NLRGEEIIGRTPTNLM AFGTPGKLLDGGKTE DQLMELLETGYARRC FFGM (SEQ ID NO: 431) | 62374 | 722 | gp43 [Enterobacteria phage N4] | YP_950521.1 | 0,0 (324/721) | No putative conserved domains have been detected |

FIG. 8AA

| | | | | | |
|---|---|---|---|---|---|
| 89 | 65567 | MGQIYTNQTGIPMAM ALWLASDYYDYSEAG LSATTLLKPIRQVVLAR RIKPSDSMADIEGMIA NRMGAAIHDSIEKAWT VNKDRALDALGIFPASV AKRVLVNPTEAELKAF NEANEQPAITVYMEQ RSKKEYAGVMVSGKY DFVADGQVEDFKSTT TFSYIKDSKDSDYILQG SIYRALNPGLITKDTMR IHFIFTDWQKFMAKQN KDYPQSRVASKVFNL MPIAETEEWTNRVKW LMSLKDTPEADLPLCS DE (SEQ ID NO: 432) | 336 | gp42 [Enterobacteria phage N4] | YP_950520.1 | 2e-73 (138/322) | No putative conserved domains have been detected |
| 90 | 65949 | MRDPRYSPHPVCKAQ HFQGQPCEDCEKLHR RLPVKSAEPAHKVQR DTAPLNRYQRPIPRA WKFVDVYRINMLFPLG ELDPSGALDHARKKL MAPGQRSGGKSLWQ DVKEARDTLNRWLED NAGEDD (SEQ ID NO: 433) | 126 | No significant similarity found | | | No putative conserved domains have been detected |
| 91 | 66374 | MEKLTPEDVPFKDFPI DSMPNLLAQMGKARA DTIRFHGLDRRSIGGP RTRMFTNPHAKRLQG LPDAFSDRGVEDILSGI ASATEGSQRPLSAARL FVLLQEPQLCYDLLMG GMALEKRQALRYMAA AKLAVFHLNRYFGASQ (SEQ ID NO: 434) | 142 | No significant similarity found | | | No putative conserved domains have been detected |

Fig. 8AB

| | | | | | | | |
|---|---|---|---|---|---|---|---|
| 92 | 66766 | MVDTCNINGVCGTGD VWNGPKPGDPNMNDLL LKATPAFGGIDIEFTW PTTNPGAVGTTRLFRS TDANFAGATIRAFVNG NFYFDKTDPGSKVDQ RYYYWMQLVSINGTDG DIIGPASATARPLIEQM IEQLTGEIDSGLSQEL RKEIAQIELNKLGITQE EIERAKNDDALGVRLT QIDAKMDQNTAILQEE VRARVTADSSLVQTV NTMYADFNGNIAAIQQ ENTALATKVNALASSV TTINATVNGIDSASGKV (SEQ ID NO: 435) | 429 | prophage LambdaSo, host specifically protein J, putative [Shewanella oneidensis MR-1] | NP_718509.1 | 2e-24 (98/281) | | |
| | | | | BcepGomrgp22 [Burkholderia phage BcepGomr] | YP_001210242 | 2e-16 (101/363) | tail protein | COG4733 | 4e-04 |
| | | | | putative phage tail protein [Escherichia coli] | YP_002519295.1 | 2e-14 (91/301) | | |
| 93 | 68052 | MSYGFRFYDANGNVT VDSTNKSFRSVYRQQ VFPVLGGTTNLPPGFD ASKGDIFFFTWFQLAP NPWPQFVDFGFVNNQ IQWYDTYSTSYGKAYL NVVSFR (SEQ ID NO: 436) | 99 | hypothetical protein PSPA7_2427 [Pseudomonas aeruginosa PA7] | YP_001347794.1 | 2e-05 (22/55) | No putative conserved domains have been detected |
| 94 | 68348 | MTYGIKLTNENSDICID ELNPVYVVVFEGSYKY DSPGQDFIYVQFPTPI RSQSLPIFFAKQDGPH GFMDFTWFGSSNGNW TGCRFVLTNFAGMAP SVYSGKYKIVAVHMPK TAGWGMQVFDADGN GVFDTGYTPAVFLGGI QRFLPYGYNPNFPGG RTLGSWYADATKIKQ GAYFRVDFGNTTFRH NGFTIGMLNGPTGWM YIAAFISGNKPGYTIDH PLLAIE (SEQ ID NO: 437) | 223 | hypothetical protein PACL_0538 [Pseudomonas aeruginosa] | ACD38786.1 | 5e-10 (40/117) | No putative conserved domains have been detected |

Fig. 8AC

| 95 | 69058 | 72177 | MTTKVJFTFHNPDGSP QANEKFTVRLTRPGM SDAEHCVVNPETYEMV TDAKGEFTMDLESSTS AYRVTAIGDDDEYEDD PCSGYTFTFYVPDSVD PYYVQELLMPPPNNL PWDEEAMNKITQAVV DARNARDDAEESADR AEAQVGLAAEQVTLAK AEVTKATAQADRSKTE ADRATTQATNAANSA TAAANSATQANTQAN RAKTEADRSKSEADR ARDLADAVAEKVEGG SLPPLVGMNETFTYEG TDPYRWTVSGPATAV SDGSVMRLTKTDGSG SRAFVRQAVSFPDSH WIVYMRVKTQTGTAS RNCSAQIRFIAADNKN CVVYFNVMANGLVEP NTIHMQGTEGDTRNA ATMFTGLGTEDWLDL AVKYDAVNRHIELFRR MPNGTWQKGGGRLM VQAIKPAFIEISSMPVA PQNWWLDTDFISVCK PNLICYGDSIAAGQNE YGVTRGNNPYNNNRN WAGTWFGKVPLYATN RNNILVLVQGVEGRRT WQYLSQLSEISNSGVK VVFIHASTNDVNDATM TMAKRTSDTQAIIDQL HAVGAQVVLFNSMQG TKAYNDASSTTVKLRD YTDQWWNTELPKVNG LAQTLDIARLIAKDGYM DPALGASDGLHLTNAS AQKIADKLGQFFSNSS DTNGFASLDSPAFTGI PTVPTQTPFLPYGKQI | tail fiber protein [Pseudomonas aeruginosa] | BAB03222.1 | 3e-75 (140/256) | tail fiber protein | SGNH_hydrolase |
|---|---|---|---|---|---|---|---|---|
| | | 1040 | | gp17 [Yersinia phage Yepe2] | YP_002003351 | 3e-07 (47/125) | | |

Fig. 8AD

Fig. 8AE

| |
|---|
| ANTEYVSTFIQDWTSN YGYGDLTMRNLTGAQ MAGGGVRSGYYYVP QDSSNPLPGNVYAFV HHMSYDTNKGWELW NHCYTDRVYMRYSNN AGVWNTPVEMVTEK VMERNSFMTPRVSAF NRLPVASSVGFEGVV PLQTNSSGAWRNVNA GVAGLGLLGATTAGN ALNYIGGMPKAPTNDR ANSNLNINLPDECGFY GLGPAPYSNIPPGVDA INPVGSTVYHQVYDAN TATQIFIPRTSDICYFR RKAGGTWSPWWRYLT DLQLVGTTTDSSAGVP NGAIMQVNGSAAVNV GVALRFADGTQIVRAL LQLDYGAVDILQRQFT FPMAFVGKPVTATLE QGTVADININMPLQAIL GPVM (SEQ ID NO: 438) |

| Phage | Titer (pfu/ml) | Phage sensitivity (%) of PSA strains (n=100) | | | | | Total of infected strains (%) |
|---|---|---|---|---|---|---|---|
| | | ++++ | +++ | ++ | + | - | |
| F770/06 | $7.7 \times 10^{12}$ | 2 | 52 | 2 | 2 | 42 | 58 |
| | $7.7 \times 10^{11}$ | 1 | 52 | 1 | 1 | 45 | 55 |
| | $7.7 \times 10^{9}$ | 1 | 44 | 4 | 1 | 50 | 50 |
| | $7.7 \times 10^{7}$ | 1 | 28 | 2 | 1 | 67 | 32 |
| | $7.7 \times 10^{5}$ | 0 | 21 | 6 | 3 | 70 | 30 |

FIG. 9

| orf | Start position | Stop position | Aminoacidic sequence | Size (aa) | Homologous/similar proteins | | | Predicted function | Conserved Domains | | |
|---|---|---|---|---|---|---|---|---|---|---|---|
| | | | | | Name[organism] | Acc No | E value and identity | | Name | Acc No | E value |
| 1 | 3 | 377 | NYPRDVSTNGTVEYLVV TSDYKRMTYRPNGTNKV FVKRKEAGSWSEWSELA INDYNTPFETVQSAQSKA NMAESNAKLYADDKFNK RYSVIFDGTANGVGSTLY LNESLDQFILLIFLWDFSR W (SEQ ID NO: 439) | 124 | hypothetical protein SACOL0384 [Staphylococcus aureus subsp. aureus COL] | YP_1852761.1 | 1e-63 (118/121) | | No putative conserved domains have been detected | | |
| | | | | | ORF007 [Staphylococcus phage 3A] | YP_239954.1 | 5e-63 (117/121) | | | | |
| 2 | 421 | 609 | LNPSNLPDGDGNGGGVY EFGLTKSSRTSLTISNDV YFDLGSQRGSGANANRG TINKIIGVRK (SEQ ID NO: 440) | 62 | hypothetical protein SPTP3102_gp61 [Staphylococcus phage tp310-2] | YP_001429956.1 | 4e-28 (62/62) | | No putative conserved domains have been detected | | |
| | | | | | tail protein [Staphylococcus phage phiSauS-IPLA88] | YP_002332629.1 | 8e-14 (39/61) | tail protein | | | |
| 3 | 609 | 977 | MQILVNKRNEIISYAIIGGF EEGIDIENLFENFSQVFR PKAFKYSNGEIVFNEDYS EEKDDLHQQIDSEEQNT VASDDILRKMVASIMQKQ VVQSTKLSMQVNKQNAL MAKQLVTLNKKIRRG (SEQ ID NO: 441) | 122 | SLT orf 129-like protein [Staphylococcus phage phi 12] | NP_803352.1 | 3e-62 (118/119) | | No putative conserved domains have been detected | | |
| 4 | 992 | 1156 | MLKLISPTFEDIKTWYQLK EYSKEDAWYVDMEVIDK EEYAIITGEKYPENLES (SEQ ID NO: 442) | 54 | ETA orf 59-like protein [Staphylococcus phage phi 12] | NP_803353.1 | 1e-22 (54/54) | | Phage_Xkd X, phage uncharacterised protein | pfam09693 | 4e-07 |

FIG. 11A

| | | | | | | | |
|---|---|---|---|---|---|---|---|
| 5 | 1203 | MFGFTKRHEQDWRLTRL EENDKTMFEKFDRIEDSL RTQEKNL (SEQ ID NO: 443) | hypothetical protein SAPPV1_gp59 [Staphylococcus phage phiNM] | 42 | YP_874008.1 | 6e-15 (40/40) | | No putative conserved domains have been detected |
| 6a | 1642 | MDAKVTTRYIVLILALVNQ FLANKGISPIPVDEESVSS IILTVVALYTTYKDNPTSQ EGKWANQKIKEI (SEQ ID NO: 444) | holin [Staphylococcus phage phiSLT] | 69 | NP_075521.1 | 1e-30 (66/68) | holin | Phage_holin, phage lysis protein | pfam04688 | 3e-09 |
| 6b | 1850 | KAESKYRKATGQAPIKEV MTPTNMNDTNDLG (SEQ ID NO: 445) | holin [Staphylococcus phage phiSLT] | 32 | NP_075521.1 | 4e-10 (31/31) | | No putative conserved domains have been detected |
| 7a | 1949 | MTNVDNKKTKQKKWFDN SLGKQFNPDLFYGFQCY DYAMMFFMIATGERLQG LYAYNIPFDNKARIEKYG QJIKNYDSFLPQKLDIWF PSKYGGGAGHVEIVESA NLNTFTSYGQNWNGKG WTNGVAQPGWGPETVT RHVHYYDDPMYFIRLNFP DKVSVGDKAKSVIKQATA KKQAVIIKPKKNYACSRS WL (SEQ ID NO: 446) | amidase [Staphylococcus phage tp310-1] | 192 | YP_001429893.1 | 6e-89 (171/176) | CHAP/amidase endolysin | CHAP domain | pfam05257 | 9e-17 |
| | 2502 | MLVAGHGYNDPGAVGN GTNEROFIRKYITPNIAKY LRIHAGHEVALYGGSSQS QDMYQIDTAYGVNVGNK KDYGLYWVKSQGYDIVL EIHLDAAGESASGGHVIIS SQFNADTIDKSIQDVIKNN LGQIRGVTPRNDLLNVNV SAEINMNYRLSELGFITN KKDMDWIKKNYDLYSKLI AGAIHGKPIGGLVAGNVK TSAKNQKKSTSASRLYTR (SEQ ID NO: 447) | putative endolysin [Staphylococcus phage phiSauS-IPLA35] | | YP_002332423.1 | 5e-113 (201/202) | | | | |
| 7b | 3143 | | amidase [Staphylococcus phage tp310-1] | 213 | YP_001429893.1 | 7e-113 (201/202) | | N-acetylmuramoyl-L-alanine amidase or MurNAc-LAA | cd02696 | 7e-21 |

FIG. 11B

| | | | | | | |
|---|---|---|---|---|---|---|
| 7c | 3079 | 3414 | MLKHQLKTKKNPPVPAG YTFPDKNNVPYKKETGYY TVANVKGNNVRDGYSTN SRITGVLPNNTITYDGAY CINGYRWTYIANSGQRR YIATGEVDKAGNRISSFG KFSTI (SEQ ID NO: 448) | truncated amidase [Staphylococcus phage phiPVL108] | 111 | YP_918945.1 | 3e-52 (100/110) | | SH3_5, bacterial SH3 domain | pfam08460 | 1e-05 |
| | | | | amidase [Staphylococcus phage tp310-1] | | YP_001429893.1 | 1e-49 (97/110) | | | | |
| 8 | 3774 | 4086 | MLYLLYSRSELYSRAEA MYLTVGPTGDIFLVITRYI YLNNIEMLHSLQPYLNRY GYIYSPTTNKTDPINLGL VWLFFCVFFGAKKRADYL KKGQTLVENLKG (SEQ ID NO: 449) | hypothetical protein SPTP3102_gp67 [Staphylococcus phage tp310-2] | 103 | YP_001429962.1 | 1e-39 (82/92) | | No putative conserved domains have been detected | | |
| 9a | 4564 | 4319 | MLTEGSYSQQKKGNPLC NNQIAGVLKKTTKALNMN KKVTTHTFRHTHITLLVE MNVSLKAIMKRVGHVDE KNINHSHIYSCN (SEQ ID NO: 450) | integrase [Staphylococcus phage PVL] | 81 | NP_058487.1 | 2e-28 (81/61) | integrase | Tn1545-related conjugative transposon integrases | cd01199 | 3e-13 |
| 9b | 5270 | 4512 | LTFHALLDEWLEYHIKTS GSKLTTLNNIKIRNIKRY SSENLLLNKLDTKYMQIFI NKLSDIYSQNQVTRQLG DMKGAIKYAVKFYNYPNE YLLTNVKIPKRRKTIEDIE KDESKMVNYLEMNQVLQ IRDHILNDNKLHKRNRLIA SILEVQALTGMRIGELQA LQEKDIDLLNKTINITGTIH RIKYEEGFGYKDTTKTISS KRSISINSRTVEIFKKIILE NKMLKRVWNSSYVDRGFI FTTKKRESFM (SEQ ID NO: 451) | integrase [Staphylococcus aureus] | 252 | BAA24009.1 | 9e-140 (247/247) | | Tn1545-related conjugative transposon integrases | cd01199 | 3e-23 |

FIG. 11C

| | | | | | | |
|---|---|---|---|---|---|---|
| 9c | 5479 | 5300 | MWIEKFKNKNNETKYRY YEKYKDPYTDKWKRVSV VLNKNTKGSQKRSNVSF RRKNKRKN (SEQ ID NO: 452) | 59 | integrase [Staphylococcus phage tp310-2] | YP_001429896.1 | 3e-19 (48/58) | | No putative conserved domains have been detected |
| 10a | 5605 | 5754 | MTQFLGALLLTGVLGYIP YKYLTMIGLVSEKKQIGYQ YSCIIDFFLLKHV (SEQ ID NO: 453) | 49 | Na/K ATPase [Staphylococcus phage phi12] | NP_803300.1 | 2e-09 (31/33) | | No putative conserved domains have been detected |
| 10b | 5795 | 6214 | LMLIQLLTGLKANILFLFIF VLTVFVFNPLIVKFIIWMLINI TRKFMKLDCISLLDKRDK LFNNNGKPVFIVIKDFEN RIIEEGELKTYNSAGSDF DLLEVERQDFKVSDLASN DELYIKITLVDLKQQIKLD LYLMNEY (SEQ ID NO: 454) | 139 | Na(+)K(+) ATPase [Staphylococcus phage phi2958PVL] | NP_075465.1 | 2e-71 (138/139) | Na/K ATPase | |
| | | | | | Na/K ATPase [Staphylococcus phage phi12] | NP_803308.1 | 9e-63 (123/129) | | |
| 11 | 6358 | 6197 | LNGGENFMVDKNKKQET TRSNPLNKSFEKSGA5E KLKSTLSEKAKKKRLVFIH (SEQ ID NO: 455) | 53 | hypothetical protein SAOUHSC_01579 [Staphylococcus aureus subsp. aureus NCTC 8325] | YP_500095.1 | 1e-14 (41/47) | | No putative conserved domains have been detected |
| | | | | | ORF130 [Staphylococcus phage 3A] | YP_239962.1 | 5e-11 (38/40) | | |
| 12 | 6845 | 6450 | METNKTIDLMNYVEFPKR YTEAKGKLVAQPITTINSA RRVENEDMTVCGYILDQD DDVMDFIFDRDIITVYCPE NGTATDEYFCEIIFNSDD TFTLKRLSNYVTIKDRSY PMSKINDVNITGIKVVRLF RDFK (SEQ ID NO: 456) | 131 | hypothetical protein phiSLTp03 [Staphylococcus phage phiSLT] | NP_075466.1 | 5e-70 (131/131) | | No putative conserved domains have been detected |

FIG. 11D

| | | | | | | | |
|---|---|---|---|---|---|---|---|
| 13 | 7280 | VKKEKTKKKKIQKKSQTQ KHKDSKPKTQQEKNEKK LKIKNPPNNSIQNNSNNQ NQSQNNQLNNNSDPSN NTPANINENDSQNTNLND EYVVSPGWTKDEQAKAF EEYKKGKEEEARAGASA VPGANIN (SEQ ID NO: 457) | 128 | putative lipoprotein [Staphylococcus phage phiPVL108] | YP_998995.1 | 4e-38 (107/114) | lipoprotein | No putative conserved domains have been detected |
| 14 | 7795 | LGLYEELCINNEKIKIEET DQLPNFQPGCYMNGKYI RRNLSEVRKAEVLYEELA HHKLTYGNILDQTKVINR KFENYARRHGFTSAVPL HEIVEAHNYGVRNLYELS EYLQLSESYILEAIEQYKK IYGIGTHYGEYSITFEPLR VFKYKEI (SEQ ID NO: 458) | 153 | phiSLT ORF153-like protein [Staphylococcus aureus subsp. aureus USA300] | YP_494132.1 | 2e-83 (151/153) | | Domain of unknown function (DUF955) | pfam06114 | 1e-04 |
| | 7334 | | | hypothetical protein SauSIPLA35_gp05 [Staphylococcus phage phiSauS-IPLA35] | YP_002332368.1 | 2e-64 (122/123) | | |
| 15 | 8137 | MENNKVRKILSENLQELM NDKNIDQRELAEAIGVSQ PTVSNWIQQTKYPRIKRI QQLADYFNVPKSRITESK KDIHQETIAAHFDKEGLT EEEIEEVNRFIEWVRNRD K (SEQ ID NO: 459) | 109 | hypothetical protein SAV0851 [Staphylococcus aureus subsp. aureus Mu50] | NP_371375.1 | 6e-57 (109/109) | cI-like repressor | HTH_XRE, helix-turn-helix XRE-family like proteins | cd00093 | 5e-08 |
| | 7808 | | | repressor [Staphylococcus phage phiSauS-IPLA35] | YP_002332369.1 | 3e-35 (74/84) | | |
| 16 | 8298 | MPEQLSVRKWRLVRDLK QQEVADILQVNAKTVGH WEKDDTNLSNVTVYALA KLYDIEVDQIKV (SEQ ID NO: 460) | 63 | cro [Staphylococcus phage phiSauS-IPLA35] | YP_002332370.1 | 2e-28 (63/63) | cro-like repressor | HTH_XRE, helix-turn-helix XRE-family like proteins | cd00093 | 3e-06 |

FIG. 11E

FIG. 11E

| | | | | | | |
|---|---|---|---|---|---|---|
| 17 | 8573 | 8749 | MNEEKLKMILLLEDIPRD EWNRLVNEVNNQYSYQA DKVGLASDNCQQIANNY KHYGF (SEQ ID NO: 461) | | hypothetical bacteriophage protein [Staphylococcus aureus subsp. aureus USA300_TCH1516] | ZP_02761849.1 | 2e-26 (56/58) | | No putative conserved domains have been detected |
| 18 | 8985 | 8748 | VISIHKRLLTQYLDKEIVTS LDLHLNGEVIKVQEHIKD AESKTLHIHPKDRVVSLD HVLYFDINVKGEKNDSP YPS (SEQ ID NO: 462) | 58 | hypothetical protein SauSIPLA35_gp08 [Staphylococcus phage phiSauS-IPLA35] | YP_002323271.1 | 3e-26 (57/58) | | No putative conserved domains have been detected |
| | | | | 79 | hypothetical protein SAS0900 [Staphylococcus aureus subsp. aureus MSSA476] | YP_043027.1 | 6e-37 (78/79) | | |
| | | | | | hypothetical protein SauSIPLA35_gp09 [Staphylococcus phage phiSauS-IPLA35] | YP_002323272.1 | 6e-35 (73/76) | | |
| 19 | 9334 | 9549 | VKKLYATPTQIHQLFGVC RSTVYNMLKYYRKDNLG VENLYIDYSPTGTLINISKL EEYLIRKHKKMVLGGY (SEQ ID NO: 463) | 71 | putative DNA-binding protein [Staphylococcus phage phiPVL108] | YP_918904.1 | 2e-30 (65/65) | DNA binding protein | No putative conserved domains have been detected |
| 20 | 9560 | 9711 | MSDTYKSYLIAVLCFTVL AIVLMPLLYFTTAWSIAGF ASIATFIYYKEYFYEE (SEQ ID NO: 464) | 53 | ORF100 [Staphylococcus phage 69] | YP_239810.1 | 4e-21 (51/53) | | Protein of unknown function (DUF1270) / pfam09900 / 8e-11 |
| 21 | 9805 | 10059 | MAENIKTEQHYYTKDFSG YRNEEDNFVANQELTVTI TLNEVYRKLIEIKAVKDKEE DTYRGKYFEEERKKRKIG KRKYKTKKQNL (SEQ ID NO: 465) | 84 | ORF046 [Staphylococcus phage 52A] | YP_240649.1 | 6e-32 (71/80) | | No putative conserved domains have been detected |

FIG. 11F

| | | | | | | | |
|---|---|---|---|---|---|---|---|
| 22 | 10116 | 10376 | MYYKIGEIKNKIISFNGFE FKVSAMKRHDGISIQIKD MNNVPFKSFHVIDLSELYI AMDAIHDVVNEWIEENTD EQDKLMNLVMKW (SEQ ID NO: 466) | hypothetical protein SPTP3103_gp13 [Staphylococcus phage tp310-3] | YP_001429975.1 | 1e-39 (77/86) | Protein of unknown function (DUF1108) pfam06531 7e-32 |
| 23 | 10390 | 10638 | MAILEDIFEELKLLNNNLR VLNTELSTVDSSNVQEKV KEAPMPKEETAQLESIEE VKETSADLTKDYVLSVGK EFLKKSRYF (SEQ ID NO: 467) | hypothetical protein MW1428 [Staphylococcus aureus subsp. aureus MW2] | NP_646245.1 | 1e-35 (78/79) | No putative conserved domains have been detected |
| | | | | hypothetical protein SPTP3102_gp18 [Staphylococcus phage tp310-2] | YP_001429913.1 | 7e-35 (77/79) | |
| 24a | 10751 | 11687 | MKLDHSNRAHAKLSASG AKQWLNCPPSIKASEGIA DKSTVFAEEGTFAHELSE LYFSLKYEGLTQFEFNKA FQNYKRNQYYSEELREY VEEYVANVEEKYNEALS RDNDWALFETKLDLGKY VPESFGTGDVIIFSGGVL EIIDLKYGKGIEVSAIDNP QLRLYGLGAYELLSLMYD IHTIRMTIIQPRIDNFSTEE LPISRLLQWGADFVKPLA RLAYNQGGEFKAGSHCR FCKINHSCRTRAEYMQN VPQKFPHLLSDEEIAELL YKLPDIKKMG (SEQ ID NO: 468) | hypothetical protein MW1427 [Staphylococcus aureus subsp. aureus MW2] | NP_646244.1 | 8e-163 (276/276) | No putative conserved domains have been detected |
| | | | | ORF012 [Staphylococcus phage 3A] | YP_239979.1 | 8e-160 (270/276) | |
| 24b | 11532 | 11807 | MKRLQNFYINCLISKKVIA DEVEQYALNQAKENDKN YPGWKLVEGRSRRMITD TKAMLEKLVEAGYKPEDI TETKLLSITNLEKLIGKKSI F (SEQ ID NO: 469) | hypothetical protein MW1427 [Staphylococcus aureus subsp. aureus MW2] | NP_646244.1 | 6e-36 (74/76) | No putative conserved domains have been detected |
| | | | | hypothetical protein phi2958PVL_gp17 [Staphylococcus phage] | YP_002267987.1 | 5e-35 (72/76) | |

FIG. 11G

| | | | | phi2958PVL | | |
|---|---|---|---|---|---|---|
| 24c | 11785 | 11918 | LVKKAFSKITEGFIEKPQG KLTLATESDKRPAIKQSA EDDFDKL (SEQ ID NO: 470) | hypothetical protein MW1427 [Staphylococcus aureus subsp. aureus MW2] | NP_646244.1 | 1e-15 (42/42) |
| | | | | hypothetical protein phi2958PVL_gp17 [Staphylococcus phage phi2958PVL] | YP_002267987.1 | No putative conserved domains have been detected |
| 25 | 11900 | 12019 | MILTNYKNLKGRYINMKA KVLNKTKVITGKVRASYA HIF (SEQ ID NO: 471) | No significant similarity found. | | No putative conserved domains have been detected |
| 26 | 12003 | 12464 | MHIFFEPHSMQEGQE3K YSISLIIPKSDTSTIKAIEQA IEAAKEEGKVSKFGGKVP ANLKLPLRDGDTEREDD VNYQDAYFINASSKQAP GIIDQNKIFRLTDSGTVVSG DYIRASINLFPFNTNGNK GIAVGLNNIQLVEKRRTS WRCKGSRR (SEQ ID NO: 472) | hypothetical protein MW1426 [Staphylococcus aureus subsp. aureus MW2] | NP_646243.1 | 2e-74 (139/140) |
| | | | | hypothetical protein phi2958PVL_gp18 [Staphylococcus phage phi2958PVL] | YP_002267988.1 | 4e-74 (138/140) No putative conserved domains have been detected |
| 27a | 12572 | 12805 | MNIDIETYSSNDISKCGAY KYTEAEDFEILIIAYSIDGG AISAIDMTKVDNEPFHAD FETFKIALFDPAVKKVGIQ C (SEQ ID NO: 473) | DNA polymerase [Staphylococcus phage phi2958PVL] | YP_002267989.1 | 2e-36 (72/72) DNA polymerase |
| 27b | 12846 | 13118 | MPPEEWICTMVNSMRIG LPASLDKVGEVLRLONQ KDKAGKNLIRYFSIPCKPT KVNGGRTRNLPEHDLEK MATIYRLLYSRCRSRNDD CS (SEQ ID NO: 474) | DNA polymerase [Staphylococcus phage phi2958PVL] | YP_002267989.1 | 2e-37 (70/70) No putative conserved domains have been detected |

FIG. 11H

| | | | | | |
|---|---|---|---|---|---|
| 27c | 13012 | MEEEQETCLNMILKKWQ QFIDYCIRDVEVEMTIAHK IKDFPVTAIEQAYWWFDQ HINDRGIKLSKSLMLGAN VLDKQSKEELLNGAKHIT GLENPNSPTQLLAWLKD DQGLDIFNLQIKKTVQEYL KEATGKAKKNARN (SEQ ID NO: 475) | 138 | DNA polymerase [Staphylococcus phage phi2968PVL] | YP_002267989.1 | 5e-66 (121/122) | No putative conserved domains have been detected |
| 27d | 13470 | MHDMMCSDERVRGLFQ FYGAGTGRWAGRGVQL QNLTKHYISDTELEIARDL IKEQRFDDLDLLLNVHPQ DLLSQLYRTTFTAEEGNE LAVSDFFGNRGKSHSMV CKRTMAFRCVQHTRKDI (SEQ ID NO: 476) | 121 | ORF003 [Staphylococcus phage 3A] | YP_239981.1 | 3e-51 (98/121) | No putative conserved domains have been detected |
| 27e | 13862 | MFNVPVESITKGDPLRQK GKVSELALGYQGGAGAL KAMGALEMGIEENELQG LVDSWRNANFNIVNFWK ACQEAAINTVKSRKTHHT HGLREFYMKKGFLMIELPS GRALAYPKASVGENSWG SQVVEFMGLDLNRKWSK LJKTYGGKLVENIVQATAR DLLAISIARLEASGFKIVG HVHDEVIVEIPRGSNGLK EIETIMNKPVDWAKGLNL NSDGFTSPFYMKD (SEQ ID NO: 477) | 225 | DNA-directed DNA polymerase [Staphylococcus aureus subsp. aureus JH9] | YP_001246416.1 | 2e-130 (225/225) | POLAc, DNA polymerase A domain |
| | 14529 | | | DNA polymerase [Staphylococcus phage phi2958PVL] | YP_002267989.1 | 6e-130 (224/225) | smart00482 | 3e-05 |
| 28 | 14542 | MQHQAYINASVDIRIPTE VESVNYNQIDKEKENLAD YLFNNPGEELLKYNVINIKV LDILEVE (SEQ ID NO: 478) | 61 | ETA orf 26-like protein [Staphylococcus phage phi 12] | NP_803319.1 | 1e-26 (61/61) | No putative conserved domains have been detected |

FIG. 11I

| | | | | | | | | |
|---|---|---|---|---|---|---|---|---|
| 29a | 14724 | 15005 | MMARRKVIRVFIKGKLMT LREVSEKYHISPELLRYR YKHKMRGDELLCGRKDS KSKDEVEYMKSQIKDEEK EREKIRKKSDFEPIPTKCE SGI (SEQ ID NO: 479) | 93 | hypothetical protein SauSIPLA35_gp19 [Staphylococcus phage phiSauS-IPLA35] | YP_002332382.1 | 1e-38 (79/80) | | |
| 29b | 14926 | 15129 | MKKKREKKSEKKAILNLY QRNVRAEYEEERKRRLR PWLYDGTPQKHSRDPY WFDVTYNQMFKKWSEA (SEQ ID NO: 480) | 67 | putative DNA-binding protein [Staphylococcus phage phi2958PVL] | YP_002287799.1 | 1e-27 (59/64) | DNA binding protein | PVL ORF-50-like family | pfam07768 | 3e-11 |
| | | | | | hypothetical protein SauSIPLA35_gp19 [Staphylococcus phage phiSauS-IPLA35] | YP_002332382.1 | 5e-27 (58/64) | | | | 1e-13 |
| 30 | 15129 | 15386 | MSIISNRKVDMNETQDNV KQPAHYTYGDIEIIDFIEQ VTAQYPPQLAFAIGNAIK YLSRAPLKNGHEDLAKAK FYVDRVFDLWEG (SEQ ID NO: 481) | 85 | hypothetical protein MW1422 [Staphylococcus aureus subsp. aureus MW2] | NP_646239.1 | 8e-44 (85/85) | | No putative conserved domains have been detected | | |
| | | | | | hypothetical protein phiETA2_gp29 [Staphylococcus phage phiETA2] | YP_001004289.1 | 4e-43 (84/85) | | | | |
| 31 | 15389 | 15589 | MATQKQVDYVMSLQEQL ELEDCEKYTDEQVKAMS HKEVSNVIENYKTSIRNE ELYYECMSFGLPNC (SEQ ID NO: 482) | 66 | hypothetical protein SAR1537 [Staphylococcus aureus subsp. aureus MRSA252] | YP_040939.1 | 5e-31 (66/66) | | No putative conserved domains have been detected | | |
| | | | | | hypothetical protein [Staphylococcus phage phiMR25] | YP_001949825.1 | 1e-28 (63/66) | | | | |
| 32 | 15683 | 15847 | VAHTHVVNGTYYFHGHIV PGWQSVKKTFDTAEELEI YIKQHGLEYEEQKQLTLF (SEQ ID NO: 483) | 54 | hypothetical protein USA300HOU_1468 [Staphylococcus aureus subsp. aureus USA300_TCH1516] | YP_001575356.1 | 3e-24 (54/54) | | Phage_Orf_51 | pfam06194 | 1e-18 |

FIG. 11J

| | | | | | | | |
|---|---|---|---|---|---|---|---|
| 33 | 15862 | MNNREQIEQSIISASAYN GNDTEGLLKEIEDVYKKA QAFDEILEGLPNAMQDAL KEDIGLDEAVGIMTGQVV YKYEEEQENEEI (SEQ ID NO: 484) | | hypothetical protein SA1786 [Staphylococcus phiN315] | NP_835543.1 | 2e-23 (53/54) | | | |
| 34 | 16116 | | 84 | hypothetical protein phi2958PVL_gp24 [Staphylococcus phage phi2958PVL] | YP_002267994.1 | 3e-39 (82/84) | Protein of unknown function (DUF1024) | pfam06260 | 2e-27 |
| 35 | 16103 | MKKFNVQITYTGMIEETIE AESLEEAEFEADVIARLE APFDCDEYEINVEEEQEN D (SEQ ID NO: 485) | 56 | hypothetical protein phiETA3_gp33 [Staphylococcus phage phiETA3] | YP_001004362.1 | 1e-22 (54/56) | No putative conserved domains have been detected | | |
| 35 | 16286 | MTNTLQVKLLSKDARMP ERNHKTDAGYDIFSAETV VLEPQEKAVIKTDVAVSIP EGYVGLLTSRSGVSSKT HLVIETGKIDAGYHGNLGI NIKNDAQVYLTTNEQCFD IQGEMENSFVNNAKKKP FTINDYYEIYKGDKLAQLV IVPIWITPELKQVEEFESV SERGAKGFGSSGV (SEQ ID NO: 486) | 175 | dUTPase [Staphylococcus phage phiPVL108] | YP_918921.1 | 7e-98 (173/176) | dUTPase | deoxyuridine 5'-triphosphate nucleotido-hydrolase | PRK00601 | 1e-24 |
| 36 | 16830 | VRERTKIYRGWNKEIFIL QGKNMNVIGLRQIFDELK RSYEGYKIVVIPIEVDFEIK (SEQ ID NO: 487) | 57 | ORF089 [Staphylococcus phage 69] | YP_239633.1 | 1e-23 (56/57) | No putative conserved domains have been detected | | |
| 37 | 17020 17307 | VTQYLVTTFKDSTGLPHE HITVARDNQTFTVVEAES KEEAKEKYEARNVPVDG ATNLNDIKSN|GIFHVEKV EPNEGMVDINIETMKPFE EADDD (SEQ ID NO: 488) | 95 | ORF054 [Staphylococcus phage ROSA] | YP_240374.1 | 3e-45 (89/95) | Protein of unknown function (DUF1381) | pfam07129 | 7e-09 |

FIG. 11K

| | | | | | | | |
|---|---|---|---|---|---|---|---|
| 38 | 17290 | 17537 | MINIPKMKFPKKYTEIISK KYKNKTPEEKAKIENDFIK DINDKDSEFYSPMMANM NEHELRAMLRMMPSLIDT GDDNDD (SEQ ID NO: 489) | hypothetical protein SPTP3102_gp35 [Staphylococcus phage tp310-2] | YP_001429930.1 | 1e-34 (77/79) | | No putative conserved domains have been detected |
| 39 | 17530 | 17916 | MIKKLKNMNWFDIFIAGIL RLFGVIALMLVVISPIYTV ASYQNKEVHQGTITDKY NKRQDKEDKFYIVLDNKQ VIENSDLLFKIKFDSADIQ ARLKVGDKVEVKTIGYRI HFLNLYPVLYEAKKVDKQ (SEQ ID NO: 490) | ORF040 [Staphylococcus phage 88] | YP_240738.1 | 9e-67 (127/128) | Protein of unknown function (DUF1523) | pfam07509 | 4e-05 |
| 40 | 17913 | 18065 | MIKQILRLLFLLAMYELGK YVTEQVYIMMTANDDVE APSDFAKIRAEVSW (SEQ ID NO: 491) | hypothetical protein SPTP3102_gp37 [Staphylococcus phage tp310-2] | YP_001429932.1 | 2e-20 (49/50) | transcriptional activator | Transcription al activator RinB | pfam06116 | 4e-17 |
| 41a | 18336 | 19444 | MLDKVTQIETIKYDRDVS YSYAASRLSTHWTNHNM AWSDFMQKLAQTVRTKE DLTEYNKMSKSEQADIKD VGGFVGGYLKEGKRRAG QVMNRSMLTLDIDYAAQ DMTDILSMFYDFAYGLYS THKHREISPRLRLRLYIPLKR NVNADEYEAIGRKVADIV GMDYFDDTTYQPHRLMY WPSTSNDAEFFFTYEDL PLLDPDKILNEYVDWTDT LEWPTSSREESKTKRLA DKQGDPEEKPGIIGAFCR AYTIEEAIETFIPDLYEKHS TNRYTYHEGSTAGGLVL YENNKFAYSHHNTDPVS GMLVNSFDLVRIHLYGAQ DEETKTDTPVNRLPSYKA MQQRAGNDEVVKKAIN (SEQ ID NO: 492) | ORF002 [Staphylococcus phage 47] | YP_240066.1 | 0.0 (348/351) | | No putative conserved domains have been detected |

FIG. 11L

| | | | | | | | |
|---|---|---|---|---|---|---|---|
| 41b | 19416 | MKLLRKGLINDKMSGDAM QDFDEIENSDDAWSETL EITSKGTFKASIPNIEIILR NDPNLKGKIAFNEFTKQI ECLGKYPWNTNFKTRQ WQDGDDSSLRSYIEKIYD IHHSGKTKDAIISVAMQN AYHPVRDYLNKISVVDGH KRLEKLFIKYLGVEDTEV NRTTTKKALTAGIARVME PGCKFDYMLTLYGPQGV GKSALLKKIRWCMVF (SEQ ID NO: 493) | ORF002 [Staphylococcus phage 47] | YP_240066.1 | 2e-114 (198/202) | ATPase | Predicted P-loop ATPase and inactivated derivatives | COG5545 | 1e-27 |
| 41c | 20104 | 20835 | MEMAELAATRIKAEVEAIK HFISKQVDRFRVAYGHYI EDFPRQCIFIGTTNKVDFL RDETGGRRFWPMTVNP ERVEVNWSKLTKDEIDQI WAEAKYYYEQGEELFLN PELEEEMRSIQSKHTEES PYTGIIIDEYLNTPIPSNVVE DLSIFERRRFYQGDVDML PTGNVDYVERNIKVCALE VFVECFGKDKGDSRGSM EIRKISNILRQLDNWSVYD GNKSGKIRFGKDYGVQIA YVRDESLEDLI (SEQ ID NO: 494) | ORF002 [Staphylococcus phage 47] | YP_240066.1 | 6e-141 (238/243) | | Predicted P-loop ATPase and inactivated derivatives | COG5545 | 1e-20 |
| 42 | 21177 | 21371 | MKESTLEKYLVKEITKLN GLCLKWVAPGTRGVPDR IIIMPEGKTFFVEMKQEKG KLHPLQKICA (SEQ ID NO: 495) | ORF053 [Staphylococcus phage 42E] | YP_239929.1 | 2e-27 (60/61) | | VRR-NUC domain | pfam08774 | 5e-08 |
| | | | | diacylglycerol kinase, catalytic region [Bacillus selenitireducens MLS10] | ZP_02170287.1 | 1e-06 (27/61) | diacylglycerol kinase | | | |

FIG. 11M

| | | | | | | | |
|---|---|---|---|---|---|---|---|
| 43 | 21364 | 21488 | VHRQFENRDHTVYVLWN KEQVNTFIRMVGGTFGD (SEQ ID NO: 496) | | ORF045 [Staphylococcus phage 3A] | YP_239996.1 | 1e-12 (34/34) | | No putative conserved domains have been detected |
| 44a | 21616 | 21828 | MLVIAPKQVAKDTWVDE VDKWNHLNHLKVSLILGT PKERNDALNTEADIYVTN KENTKVMLCDQYKKRMAI (SEQ ID NO: 497) | | phage helicase [Staphylococcus phage phi2958PVL] | YP_002268001.1 | 4e-32 (65/68) | | No putative conserved domains have been detected |
| 44b | 21830 | 22819 | MVVIDELSTFKSPKSQRF KSIKKKLPLINRFIGLTGTP SPNSLQDLWAQVYLDR GERLESSFSRYRERYFK PTHQVSEHVFNWELRDG SEEKIYERIEDICLSMKAK DYLDMPDRVDTKQTVVL SEKERKVYEELEKNYILE SEEEGTVVAQNGASLSQ KLLQLANGAVYTDDEDV RLIHIDKKLDKLEEIIEESQ GQPILLFYNFKHDKERILQ RFKEATTLEDSNYKERW NSGDIKLLIAHPASAGHG LNLQQGGHHIVWFGLTWS LELYQQANARLYRQGQN HTTIHHIMTDNTIDQRVY KALQNKELTQEELMKAIK ARIAKHK (SEQ ID NO: 498) | 329 | helicase [Staphylococcus phage phi 12] | NP_803332.1 | 0,0 (327/329) | helicase | HELICc,helic ase superfamily c-terminal domain | cd000079 | 0,002 |
| 45 | 22832 | 23269 | MGNTIYDIKPGTFKYIESE IYNLNENKKEIKRLREIL NPTKEQDSNIVYGPLQK GEPVRTTELMATRLLTNK MLRNLEEMVEAVESEYL KLPEDHKKVIRLKYWNKE KKLKMEQIGHECHMHRN TVTTIRKNFVKAVAYHAGI K (SEQ ID NO: 499) | 145 | hypothetical protein phiSLTp36 [Staphylococcus phage phiSLT] phi SLT ORF 145-like protein, phage transcriptional regulator [Staphylococcus aureus subsp. aureus | NP_075498.1 YP_494104.1 | 6e-79 (145/145) | transcriptional regulator | No putative conserved domains have been detected |

FIG. 11N

| | | | | [USA300] | | | | |
|---|---|---|---|---|---|---|---|---|
| 46 | 23426 23758 | MTKHNNIYKHGRKSYQY DWFYHSKAWKKLREIAL DRDNYLCQMCLREDIVT DANIVI-HIIYVDEDFNKAL DLDNLMSVCYSCHNKIHA NDNDKSNLKKIRVLQNLN KKII (SEQ ID NO: 500) | 110 | ORF046 [Staphylococcus phage 42E] | YP_239933.1 | 4e-53 (102/103) | endonuclease | McrA, restriction endonuclease [Defense mechanisms] | COG1403 | 2e-04 |
| 47 | 23945 24178 | LYIETYEFYCRLRDELKN SDLMIEHTNKAGASNIIKN PLSIELTKTVQTLNNLLKS MGLTAAQRKKIVQEEGG FGDY (SEQ ID NO: 501) | 77 | ORF037 [Staphylococcus phage 3A] | YP_239934.1 | 4e-38 (77/77) | terminase small subunit | Terminase_4, phage terminase, small subunit | pfam05119 | 2e-12 |
| 48a | 24168 24518 | VTIKVLNEPSPKLLTVVY AEQVTQGKIKTSKYVRKE CERHLRYLENGGKWVFD EELAHRPIRFIEKFCKP3K GSKRQLVLQPWQHFINGS LFGWHKETKLRRFKEA LIFMGRKKW (SEQ ID NO: 502) | 116 | putative terminase large subunit [Staphylococcus phage phiSauS-IPLA35] | YP_002332401.1 | 3e-63 (113/114) | terminase large subunit | Terminase_1, phage terminase | pfam03354 | 6e-05 |
| 48b | 24604 24789 | MKQARILFDESKAMIKAS PKLDKNFRTLRDEIHYDA TISKIMPQASDSDKLDGL NTHMGIF (SEQ ID NO: 503) | 61 | ORF005 [Staphylococcus phage 3A] | YP_239935.1 | 2e-28 (61/61) | | | | 0.001 |
| 48c | 24818 24997 | LISVIKNSRAARLQPLLIYI TTAGYQLDGPLVDMVEA GRDTLDQIIEDERTFLLFS IFG (SEQ ID NO: 504) | 59 | ORF005 [Staphylococcus phage 47] | YP_240002.1 | 6e-23 (52/52) | | | | 0.004 |
| 48d | 24990 25205 | LDDDDINDSSNWIIKANP NLGVSINLDEMKEEWEK AKRTPAERGDFHTKRFNIF ANNDEMSFIDYPTLQKK (SEQ ID NO: 505) | 71 | terminase large subunit [Staphylococcus phage phi2958PVL] | YP_002268005.1 | 5e-34 (70/70) | | | | 7e-08 |

FIG. 11O

| | | | | | | | |
|---|---|---|---|---|---|---|---|
| 48e | 25177 | LITQHSKKNNEIVSLEELE GRPCTGYDLSETEDFTA ACATFALDNGKVAVLSHS WFKHKVEYSNEKIPYRE WEEDGLLTVQDKPYIDY QDVLNMIKMNEHYVVEK ITYDRANAFKLNQELKKL RV (SEQ ID NO: 506) | 128 | terminase large subunit [Staphylococcus phage phi2958PVL] | YP_002268005.1 | 4e-65 (117/118) | | 4e-08 |
| 48f | 25563 25864 | LSPALKQLKEMFLDGKIIF NNNPLMKWYINNVQLKL DRNGNWLPSKQSRYRKI DGFAAFLNTYTDIMNKVV SDSGEGNIEFISIKDIMR (SEQ ID NO: 507) | 89 | putative terminase large subunit [Staphylococcus phage phiSauS-IPLA35] | YP_002332401.1 | 2e-45 (89/89) | | 6e-08 |
| 49a | 25869 | VNVIAKENIVTRIKKKLIDN WIDQSTSKLYDFSPWKN RSFWGVINNTLETNETIF SAITKLSNSMASLPLKMY EDYKVVNTEVSDLLTVSP NNSLSSFDFINQIETIRNE KGNAYVLIERDIYHQPSK LFLLNPDVVEMLIENQSR ELYYSIHAATGNKLVHN MDMLHFKHIVASNMVQGI SPIDVLKNTTDFDNAVRT FNLTEMQKT (SEQ ID NO: 508) | 209 | portal protein [Staphylococcus phage phiSLT] | NP_075502.1 | 4e-117 (207/208) | portal protein | Phage portal protein pfam04860 | 3e-39 |
| 49b | 26506 26580 | MLKYGSNVGKEKKAASV RRFQTVL (SEQ ID NO: 509) | 24 | portal protein [Staphylococcus phage phi2958PVL] | YP_002268006.1 | 0.007 (15/24) | | No putative conserved domains have been detected |
| 49c | 26728 27111 | MQDQIQISRKNEELNRFY LQHTLLPIVKQYEEEFNR KLLTKTDREKNRYFKFNV KSYLRADSATQAEVYFKA VRSGYYTINDIREWEDLP PVEGDDKPLISGDLYPID TPLELRKSLKGGDKIWN ES (SEQ ID NO: 510) | 127 | head portal protein [Staphylococcus phage phi 12] | NP_803337.1 | 4e-64 (118/118) 348 | | Phage portal protein pfam04860 | 5e-18 |

FIG. 11P

| | | | | | | | |
|---|---|---|---|---|---|---|---|
| 50a | 27095 | MSMKAKYFQMKRKSKSK GEIFIYGDIVSDKWFESD VTATDFKNKLDELGDISEI DVHINSSGGSVFEGHAIY NMLKNASCKN (SEQ ID NO: 511) | | | | | |
| | | bacteriophage protease [Staphylococcus aureus subsp. aureus USA300_TCH1516] | 82 | ZP_02759748.1 | 9e-38 (77/81) | | |
| | | protease [Staphylococcus phage phiSLT] | | NP_075503.1 | 1e-37 (77/81) | Clp protease | CLP_protease | pfam00574 | 4e-09 |
| 50b | 27324 | MHPAKINIYYDALAASIAS VIAMSGDTIFMHKNSFLMI HNSWVMTVGNAEELRKT ADLLEKTDAVSNSAYLDK AKDLDQEHLKQMILDAET WLTAEEALSFGLIDEILGA NEIAASISKEQYKRFENV PEDLKKDVDKITKIDDVDT SELVETPKESMSLEEKRIK KEKKIKRECEILKNDNELL GGNEMPTLYELKQSLGM IGQQLKK (SEQ ID NO: 512) | | | | | |
| | | bacteriophage protease [Staphylococcus aureus subsp. aureus USA300_TCH1516] | 207 | ZP_02759748.1 | 4e-89 (164/167) | | |
| | | protease [Staphylococcus phage phiSLT] | | NP_075503.1 | 2e-87 (173/177) | | CLP_protease | pfam00574 | 8e-27 |
| 51 | 27959 | LSQKATDPNIDMEDIKQL ETEKAGLQQRFNIVERQV QDIEEKEKAKVKDKGEAY QSLSDNEKMIVKAKAEFY RHAILPNEFEKPSMEAQR LLHALPTGNDSGGDKLLP KTLSKEIWSEPFAKNQLR EKARLTNIKGLEIPRVSYT LDDDDFITDVETAKELKA KGDTVKFTTNKFKVFAAI SDTVIHGSDVDLVNWVE NALQSGLAAKERKDALA VSPKSGLEHMSFYNGSV KEVEGADMYDAHNALAD LHEDYRDNATIYMRYADY VKIISVLSNGTTNFFDTPA EKVFGKPVVFTDAAVKPI VGDFNYFGIINYDGTTYDT | 339 | | | | |
| | | hypothetical protein phiSLTp42 [Staphylococcus phage phiSLT] | | NP_075504.1 | 0.0 (328/337) | major capsid protein | Phage capsid family | pfam05065 | 4e-04 |

FIG. 11Q

| | | DKDVKKRRIFVCINSMV (SEQ ID NO: 513) | | | | |
|---|---|---|---|---|---|---|
| 52 | 29120 | MSLEEIKLWLRIDYNFEN DLEGLIQSAKSELLSGV PDYDKDDLEYPLFLYSD (SEQ ID NO: 514) | 54 | hypothetical protein phiSLTp43 [Staphylococcus phage phiSLT] | NP_075505.1 | 3e-20 (50/53) | No putative conserved domains have been detected |
| 53 | 29482 | MKRKKMKLYSCFCKIYNP SMKDREILKATESKSGLT IMRSSKIEYLPQTNHLVKI DRGLYSDKLFNIKEIRIDT PDIGYNTVVLSEK (SEQ ID NO: 515) | 88 | hypothetical protein phiSLTp44 [Staphylococcus phage phiSLT] | NP_075506.1 | 9e-42 (84/87) | No putative conserved domains have been detected |
| 54a | 29745 | MSVEIKGIPEVLKKLESVY GKQSMQAKSDRALNEAS EFFYKGFKERIREF (SEQ ID NO: 516) | 50 | ORF028 [Staphylococcus phage 3A] | YP_239942.1 | 5e-15 (42/50) | No putative conserved domains have been detected |
| 54b | 29842 | MKHLNFFIKALKKEFESF KDTGASIEEMTKSKPYTK VGSQERAVLIEWVGPMN RKNIIHLNEHGYTRDGKKI YTKRFWSYCKNISC (SEQ ID NO: 517) | 86 | hypothetical protein SauSIPLA35_gp44 [Staphylococcus phage phiSauS-IPLA35] | YP_002332407.1 | 3e-33 (68/81) | No putative conserved domains have been detected |
| 55 | 30149 | MNILNTIKGILLSDAELKT HINSRIYYYKVTENAETSK PFVVITPVYDLPSDFMSD KYLSEEYLIQIDVESSNN QKTDITKRIRYLLYQQNLI QASSQLDAYFEETKRYV MSRRYQGIPKNIYYKNQR IE (SEQ ID NO: 518) | 131 | hypothetical protein phiSLTp46 [Staphylococcus phage phiSLT] | NP_075508 | 3e-69 (131/131) | No putative conserved domains have been detected |

FIG. 11R

| | | | | | | | | |
|---|---|---|---|---|---|---|---|---|
| 56a | 30580 | 30975 | MAEGQGSYKVGFKRLYV GVFNPEATKVVKRMTWE DEKGGTVDLNITGLAPDL VDMFASNKRVVMKKQG TNEVKSDMSIFNIPSDDL NTVIGRTKDKKWYILGRR EYKSTVCNSNWRIGRWF NRSAGICSLT (SEQ ID NO: 519) | 131 | major tail protein [Staphylococcus phage phi 12] | NP_803343.1 | 1e-49 (99/96) | Phage major tail protein | pfam0463 0 | 6e-26 |
| 56b | 31064 | 31183 | MNRKVDVDGTSQGIVYG YHEGKEGETEFFKKSIR WIHGQ (SEQ ID NO: 520) | 39 | major tail protein [Staphylococcus phage phiSLT] | NP_075509.1 | 6e-10 (31/31) | | No putative conserved domains have been detected | |
| 57 | 31180 | 31281 | VKIIQRILQVRYPANPQNV EVAVNSKSATVSAE (SEQ ID NO: 521) | 33 | ORF083 [Staphylococcus phage 42E] | YP_239887.1 | 6e-10 (33/33) | major tail protein [Staphylococcus phage phi 12] | No putative conserved domains have been detected | |
| 58 | 31315 | 31770 | MTKTLKVYKGDDVVASE QGEGKVSVTLSNLEADT TYPRGSTYQVAWEENGKE SSKVDVPQFKTNPILVSG VSFTPETKSITVNADDNV EPNIAPSTATNKTLKYTS EHPEFVTVDERTGAIHGV AEGTSVITATSTDGSDKS GQITVTVTNG (SEQ ID NO: 522) | 151 | major tail protein [Staphylococcus phage phiSLT] | YP_075510.1 | 2e-80 (151/151) | major tail protein | Bacterial surface proteins containing Ig-like domains | COG5492 | 5e-07 |
| | | | | | major tail protein [Staphylococcus phage phi 12] | NP_803344.1 | 2e-77 (146/151) | | | |
| 59 | 31829 | 32179 | MIKFEIKDRKTGKTESYT KEDVTMGEAEKCYEYLE LVNQENKKEAPNATKMR QKERQLLVDLFKDEGLTE EDVLNKMSTKTYTKALQ DIFREINGEDEEDSETEP EEMGKTEEQSQ (SEQ ID NO: 523) | 116 | hypothetical protein phiSLTp49 [Staphylococcus phage phiSLT] | NP_075511.1 | 3e-59 (116/116) | | No putative conserved domains have been detected | |

FIG. 11S

| | | | | | | |
|---|---|---|---|---|---|---|
| 60 | 32221 | 32331 | MEQYGWTLEVRKQPYV KLLEILNEENKEETEEKTK (SEQ ID NO: 524) | 37 | ORF103 [Staphylococcus phage 42E] | YP_239870.1 | 4e-05 (23/23) | | No putative conserved domains have been detected |
| 61a | 32394 | 32579 | MNEKVEGMTLELKLDHL GVQEGMKGLKRQLGVV NSEMKANLSAFDKSEKIN GKNIRRELRG (SEQ ID NO: 525) | | tail fiber protein [Staphylococcus phage phi 12] | NP_803346.1 | | | No putative conserved domains have been detected |
| | | | | 62 | putative tape measure protein [Staphylococcus phage phiSauS-IPLA35] | YP_002332413.1 | 6e-20 (49/49) | | |
| 61b | 32580 | 32741 | MIGLKFKKKMYSQVEDEL KQVNANYQKAKSSVKDV EKAYLKLVEANKKRKISS (SEQ ID NO: 526) | 53 | putative tape measure protein [Staphylococcus phage phiSauS-IPLA35] | YP_002332413.1 | 4e-16 (44/49) | | No putative conserved domains have been detected |
| 61c | 32852 | 33016 | LRDAEQKLKNSNQATTA QLKRASDAVQKQSAKHK ALVEQYKQEGNQVQKTK SAK (SEQ ID NO: 527) | 54 | putative tape measure protein [Staphylococcus phage phiSauS-IPLA35] | YP_002332413.1 | 1e-19 (50/51) | | No putative conserved domains have been detected |
| 61d | 33223 | 34206 | MKTFNKEQMIAQSHFGK LASQADVMSKKFSSIGDK MTSLGRTMTMGVSTPITL GLGAALKTSADFEGQMS RVGAIAQASSKDLKSMS NQAVDLGAKTSKSANEV AKGMEELAALGFNAKQT MEAMPGVISAAEASGAE MATTATVMASAINSFGLK ASDANHVADLLARSAND SAADIQYMGDALKYAGT PAKALGVSIEDTSAAIEVL SNSGLEGSQAGTALRAS FIRLANPSKNTAKEMKKL GIHLSDAKGQFYGMGELI RQFQDNMKGMTREQKL ATVATIVGTEAASGFLAIJ EAGPDKINSYSKSLKNSN GESKKSSRFDER (SEQ ID NO: 528) | 327 | tail length tape measure protein [Staphylococcus phage phi2958PV-L] | YP_002280017.1 | | tape measure protein | |
| | | | | | | YP_002332413.1 | 0.0 (320/322) | | Phage-related minor tail protein / pfam1014 5 / 1e-35 |
| | | | | | putative tape measure protein [Staphylococcus phage phiSauS-IPLA35] | | | | |

FIG. 11T

| | | | | | | |
|---|---|---|---|---|---|---|
| 61e | 34166 | 34816 | MAKVKKAADLMKDNLKG ALEQLGGGAFESLAIEVGK DLTPMIRAGAEGLTKLVD GFTHLPGWVRKASVGLA LFGAAIGPAVLAGGLLIRT VGSAAKGYABLNRRIAEN TILSNTNSKAMKSLGLQT LFGSTTQKTSKGFKGLA GAMMFNLKPINVLKNSAK LAILPFKLLKNGLGLAAKS LFAVSGGARFAGVALRFL TGPIGATTIAITIAYKVF (SEQ ID NO: 529) | 216 | putative tape measure protein [Staphylococcus phage phiSauS-IPLA35] | YP_002332413.1 | 6e-116 (212/212) | No putative conserved domains have been detected |
| 61f | 34797 | 35003 | LRIKFFKTAYDRVEWFRN GINGLGETIKFFGGKIIGG AVRKLGEFKKLSWKYRQ KLQRKVFKRYERWL (SEQ ID NO: 530) | 68 | ORF001 [Staphylococcus phage 3A] | YP_239947.1 | 5e-17 (42/43) | No putative conserved domains have been detected |
| | | | | | putative tape measure protein [Staphylococcus phage phiSauS-IPLA35] | YP_002332413.1 | 7e-17 (42/43) | |
| 61g | 34987 | 35097 | MKDGYKSLSDDDLLKVG VNKFKGFMQTMGTASKK SV (SEQ ID NO: 531) | 36 | ORF001 [Staphylococcus phage 3A] | YP_239947.1 | 2e-11 (34/35) | No putative conserved domains have been detected |
| | | | | | putative tape measure protein [Staphylococcus phage phiSauS-IPLA35] | YP_002332413.1 | 2e-11 (34/35) | |
| 61h | 35108 | 35257 | VLGKGVSKETEKALEKYV HYSEENSRIMEKVRLNS GQISEDKAKKTFEN (SEQ ID NO: 532) | 49 | putative tape measure protein [Staphylococcus phage phiSauS-IPLA35] | YP_002332413.1 | 3e-17 (45/48) | No putative conserved domains have been detected |

FIG. 11U

| | | | | | | |
|---|---|---|---|---|---|---|
| 61i | 35404 | 35478 | MTCELKKEQELNQKIKEL KEKSFE (SEQ ID NO: 533) | 24 | TP901 family phage tail tape measure protein [Staphylococcus aureus subsp. aureus JH9] | YP_001246447.1 | 2e-07 (17/17) | No putative conserved domains have been detected |
| 61j | 35471 | 35857 | LSDGQISENERKEIEKLE NQRRDITVKELSKTEKEQ ERILVRMQRNRNAYSIDE ASKAIKEAEKARKARKKE VDKQYEDDVIAIKNNVNL SKSEKDKLLAIADQRHKD EVRKAKSKKDAVVDVVK KAK (SEQ ID NO: 534) | 128 | putative tape measure protein [Staphylococcus phage phiSauS-IPLA35] | YP_002332413.1 | 1e-06 (16/16) | No putative conserved domains have been detected |
| 61k | 35924 | 36220 | MALKVGGLTLEKTKRKKS DKYAKEQEETARRNRENI KKWFGNAWDGVKSKTG EAFSKMGRNANHFGGE MKKNIVERNQRDSKQIKF RLELSQKFCRIPH (SEQ ID NO: 535) | 98 | tail length tape measure protein [Staphylococcus phage phi2958PVL] | YP_002268017.1 | 3e-64 (126/126) | No putative conserved domains have been detected |
| | | | | | putative tape measure protein [Staphylococcus phage phiSauS-IPLA35] | YP_002332413.1 | 6e-26 (56/58) | |
| 61l | 36138 | 37214 | MWSGIKGIPSKLSSGWS SAKSSVGYHTKAIANSTG KIWFGKAWQSVKSTTGSI YNQTKQKYSDASDKAWA HSKSIWRGTSKWFSNAY KSAKGWLTDMANKSRAK WDNISSTAWSNAKSWK GTSKWFSNSYKSLKDWT GDMYSRAHDRFDAISSS AWSNAKSVFNGFRKVMLS KTYDWIRDIGKDMGRAA ADLGKNVANKAIGGLNS ... | 358 | putative tape measure protein [Staphylococcus phage phiSauS-IPLA35] | YP_002332413.1 | 0.0 352/352 | No putative conserved domains have been detected |

FIG. 11V

| | | | | | | |
|---|---|---|---|---|---|---|
| | | IPTLSTGTLAGKGVATDN SGALTQPTFAVLNDRGS GNAPGGGVQEMHRADG TFHAPQGRDVVVPLGVG DSVINANDTLKLQRMGVL PKFHGGTKKDWLDQLK GNIGKKAGEFGATAKNTA HNIKIKRCRRNG (SEQ ID NO: 536) | | | | |
| 61m | 37207 | MVEAAGDKIKDGASWLG DKIGDVWDYVQHFGKLV NKVMSGLNMFGGGANA TVKIAKGAYSLLKKEISRQ SKIVV (SEQ ID NO: 537) | phi12 tail fiber protein-like protein [Staphylococcus aureus bacteriophage phi 3A] | AAM49603.1 | 7e-31 (65/67) | No putative conserved domains have been detected |
| | 37434 | | putative tape measure protein [Staphylococcus phage phiSauS-IPLA35] | YP_002332413.1 | 1e-28 (61/61) | |
| 61n | 37556 38458 | MPSGTNVYAVKGGIADK VWTDYGGGNSIQIKTGA NEWNWMHLSKQLARQ GQRIKAGQLIGKSGATGN FVRGAHLHFOLMQGSHP GNDTAKDPEKWILKSLKG SGVRSGSGVNKAASAW AGDIRRAAKRMGVNVTS GDVGNIISLIQHESGGNA GITQSSALRDINVLQGNP AKGLLQYIPQTFRHYAVR GHNNIYSGYDQLLAFFNN RYWRSQFNPRGGWSPS GPRRYANGGLITKHQLAE VGEGDKQEMVIPLTRRK RAIQLTEQVMRIIGMDGIK PNNITVNNDTSTVEKVET NCYVK (SEQ ID NO: 538) | putative tape measure protein [Staphylococcus phage phiSauS-IPLA35] | YP_002332413.1 300 | 2e-175 (291/294) | Lytictransglycosylase (LT) and goose egg white lysozyme (GEWL) domain cd00254 7e-07 |

FIG. 11W

| | | | | | | | | |
|---|---|---|---|---|---|---|---|---|
| 61o | 38448 | MLSDKGNKLTDALIQTVS SQDNNLGSNDAIRGLEKI LSKQSGHRANANNYMG GLTN (SEQ ID NO: 539) | | tail fiber protein [Staphylococcus phage phi 12] | NP_803346.1 | 2e-24 (56/56) | | No putative conserved domains have been detected |
| | 38618 | | 56 | putative tape measure protein [Staphylococcus phage phiSauS-IPLA35] | YP_002332413.1 | | | |
| 62a | 38618 | MQSFVKIIDGYKEEVITDF NQLIFLDAR AESPNTNDN SVTINGVDGILPGAISFAP FFISIKVVL (SEQ ID NO: 540) | 65 | hypothetical protein phiSLTp52 [Staphylococcus phage phiSLT] | NP_075514.1 | 3e-25 (57/62) | | Protein of unknown function (DUF1306) pfam06997 0.002 |
| | | | | holin-like protein [Staphylococcus phage phi 12] | NP_803346.1 | 4e-25 (57/62) | | |
| 62b | 38907 | MPGVKYAVNTANVTSNL KDGSSTEIEVSLNVYKGY SESVNWTDSEFLFDSNW MFENGIPLDFTPKYTHTS NQFTIWNGSTDTINPRFK HDLKILINLNASSGGFELVN YTTGDIFKYNKSIDKNTDF VLDGVYAYRDINRVGIDT NRGIITLAPGKK (SEQ ID NO: 541) | 156 | holin-like protein [Staphylococcus phage phi 12] | NP_803346.1 | 1e-94 (155/155) | holin | Protein of unknown function (DUF1306) pfam06997 2e-45 |
| 63a | 39453 | MDYHDHLSVMDFNELIC ENLLDVDYGSFKEYYELN EARYITFTVYRTTHNSFV FDLLICENFIIYHGEKYTIK QTAPKVEGDKVFIEVTAY HIMYEFQNHSVESNKLD DDSSETGKTPEYSLDEYL RYGFANQKNFGQINDL (SEQ ID NO: 542) | 141 | hypothetical protein SPTP3102_gp58 [Staphylococcus phage tp310-2] | YP_001429953.1 | 2e-74 (134/134) | | Protein of unknown function (DUF1142) pfam06605 4e-45 |
| | 39878 | | | hypothetical protein SauSIPLA35_gp52 [Staphylococcus phage phiSauS-IPLA35] | YP_002332415.1 | 6e-69 (125/134) | | |

FIG. 11X

| | | | | | | | | | |
|---|---|---|---|---|---|---|---|---|---|
| 63b | 39868 | 40329 | MTYKIIGDFKRKVPIDELG NKNGLEYGKEAVDLFGCI IYPNDTEIGFYSPETFYQ RSEKVIRYQYNTDTVSAT VSTLELRTAIKVFGKKYTA EEKKNYNPIRTTDIKYSN GFIKEGTYRTETIGSKATI NFDCKYGNETVRFTIKKG LSRWNI (SEQ ID NO: 543) | 153 | ORF006 [Staphylococcus phage 47] | YP_240019.1 | 4e-81 (147/147) | Protein of unknown function (DUF1142) | pfam06605 | 8e-32 |
| 63c | 40331 | 40504 | LILDGKQIKQISCFAKSVQ SETIDLIKNIDKGKHVLEMI FLGEDPKNRIDISSNKKS (SEQ ID NO: 544) | 57 | hypothetical protein SauSIPLA35_gp52 [Staphylococcus phage phiSauS-IPLA35] | YP_002332415.1 | 5e-81 (147/147) | No putative conserved domains have been detected | | |
| | | | | | ORF006 [Staphylococcus phage 3A] | YP_239951.1 | 1e-24 (56/57) | | | |
| 63d | 40516 | 40710 | MLELKKSTVLNLIADNSG RNQYKAIVDYVADSAKQF GIRYANTQTNEDIETQDK LLEFAKKANK (SEQ ID NO: 545) | 64 | hypothetical protein SauSIPLA35_gp52 [Staphylococcus phage phiSauS-IPLA35] | YP_002332415.1 | 8e-24 (55/57) | | | |
| | | | | | hypothetical protein SauSIPLA35_gp52 [Staphylococcus phage phiSauS-IPLA35] | YP_002332415.1 | 1e-24 (56/57) | Protein of unknown function (DUF1142) | pfam06605 | 2e-12 |
| 63e | 40688 | 41041 | LQKKQINDTPKTELDVNYI GYEKIEPRDSVFFVHELM GYNTELKVVKLDRSHPFV NAIDEVSFSNEIKDMVQI QQALNRRVIAQDNRYNY QANRINHLYTSTLNSPFE TMDIGSVLI (SEQ ID NO: 546) | 117 | hypothetical protein SauSIPLA35_gp52 [Staphylococcus phage phiSauS-IPLA35] | YP_002332416.1 | 3e-62 (115/117) | Protein of unknown function (DUF1142) | pfam06605 | 2e-27 |
| 64 | 41041 | 41331 | MATEEVKIKALLENDKQY FPATHWKAINGIPYAGSS DIDGLPQDGIISVDDKNKL DKLKIGEAGIIQNSIVQKS PNGKLWKITVDDSGKLG TVLFY (SEQ ID NO: 547) | 96 | hypothetical protein phiSLTp54 [Staphylococcus phage phiSLT] | NP_075516.1 | 5e-48 (96/96) | PRK05926, hypothetical protein | PRK05926 | 3e-04 |

FIG. 11Y

| | | | | | |
|---|---|---|---|---|---|
| 65a | 41347 | MENLYLIKDLGALAGRDY RAKEIQNLQRIEQFALGL TTEFKLHQKAKTMQHFA EQIYYNGRSQAAVNKSL QSQINALVVAPRNNSANE IVQARVNVNGETFDTLKE HLDDWETKTQINKEETIR ELNKTKQEILDIEYRFEPD KQEFLFVTELAPILTNAVM QSFWFDNRTGIVYMTQA RNNGYMLSRLRPNGQFI DSSLIVGGGSWYT (SEQ ID NO: 548) | | hypothetical protein phi2958PVL_gp50 [Staphylococcus phage phi2958PVL] | YP_002268021.1 | 1e-115 (204/204) | No putative conserved domains have been detected |
| | 41973 | | 208 | minor structural protein [Staphylococcus phage phiSaus-IPLA35] | YP_002332417.1 | 1e-114 (202/204) | |
| 65b | 41951 | VGGHGTHNGYRYIDDEL WIYSFILNGNNENTLVRF KYTPNVEISYGIKYGMQD VFTGHPEKPYITPVINEKR K (SEQ ID NO: 549) | | hypothetical protein phiSLTp55 [Staphylococcus phage phiSLT] | NP_075517.1 | 1e-34 (69/69) | No putative conserved domains have been detected |
| | 42169 | | 72 | minor structural protein [Staphylococcus phage phiSaus-IPLA35] | YP_002332417.1 | 1e-34 (69/69) | |
| 65c | 42153 | MKKENIKILYRIERPRSQW ELENSMNYIEIRSLDDVD KNIDKVLHKSIPMRLTNE TQPMQGVTFDEKYLYWY TGDSNPNNRNYLTAFDL ETGEEAYQVNADYGGTL DSFPGEFAEAEGLQIYYD KDSGKKSFDARCYCRW (SEQ ID NO: 550) | | hypothetical protein phiSLTp55 [Staphylococcus phage phiSLT] | NP_075517.1 | 9e-71 (128/131) | No putative conserved domains have been detected |
| | 42575 | | 140 | minor structural protein [Staphylococcus phage phiSaus-IPLA35] | YP_002332417.1 | 1e-70 (128/131) | |
| 65d | 42520 | MTKIVVKKALMLGVTVGG DGNRTHRIFMIGQRGILEI LHSRGVPFIMSDTGGRV KPLPMRPDKLKNLGMLT EPGLYYLYTDHTVQIDDF PLPREWRDAGWFLEVKP PQTGGDVIQILTRNSYAR NMMTFERVLSGRTGDIS DWNYVPKNSGKWERVP | | hypothetical protein phiSLTp55 [Staphylococcus phage phiSLT] | NP_075517.1 | 3e-89 (156/156) | No putative conserved domains have been detected |
| | 43020 | | 166 | minor structural protein [Staphylococcus phage phiSaus-IPLA35] | YP_002332417.1 | 4e-89 (156/156) | |

FIG. 11Z

| | | | | | | | |
|---|---|---|---|---|---|---|---|
| 65e | 43007 | | SFITKNVRY (SEQ ID NO: 551) | | | | No putative conserved domains have been detected |
| | 43281 | 43261 | MSDINIVGMSFYLTTDDT KRFTDFPTERKGVAGWN LYVEASNTGGFVHRLVR NSVTASAEILLKNYDSKT SSGPWTLHEGRIIS (SEQ ID NO: 552) | 84 | hypothetical protein phi2958PVL_gp50 [Staphylococcus phage phi2958PVL] | YP_002268021.1 | 1e-42 (04/84) |
| | | | | | minor structural protein [Staphylococcus phage phiSauS-IPLA35] | YP_002332417.1 | |
| 66 | 43281 | 43481 | MSNLEKSVAINLENTAHY ENISNLDITFRTGESDSSV LLFNIIKNNQPLLLSEENIK ARJAIRGKGV (SEQ ID NO: 553) | 66 | ORF005 [Staphylococcus phage 42E] | YP_239878.1 | 2e-30 (67/67) |
| | | | | | | Domain of unknown function (DUF2479) | pfam10651 | 6e-16 |

FIG. 11AA

| Phage | Titer (pfu/ml) | Phage sensitivity (%) of STA strains (n=100) | | | | | Total of infected strains (%) |
|---|---|---|---|---|---|---|---|
| | | ++++ | +++ | ++ | + | - | |
| F197/08 | $1,9 \times 10^{11}$ | 14 | 61 | 8 | 14 | 3 | 97 |
| | $1,9 \times 10^{9}$ | 8 | 22 | 18 | 17 | 35 | 65 |
| | $1,9 \times 10^{7}$ | 2 | 1 | 8 | 12 | 77 | 23 |
| | $1,9 \times 10^{5}$ | 1 | 1 | 1 | 4 | 93 | 7 |
| | $1,9 \times 10^{4}$ | 0 | 0 | 0 | 1 | 99 | 1 |

FIG. 12

| orfs | Start position | Stop position | Product aminoacidic sequence | Size (aa) | Homologous/similar proteins | | | Predicted function | Conserved Domains | | |
|---|---|---|---|---|---|---|---|---|---|---|---|
| | | | | | Name[organism] | Acc No | E value and identity | | Name | Acc No | E value |
| 1 | 58 | 525 | MAGRPKKLLSNSNIKNYTKE EIIEKERQEAQLNKFSKIDT EPPHFLDEIAKQEYLRILPH MQELPISNLDKAQLAQYCS FYSDFVKASLILEREDLILED DKGNQKVNPAFNIKEKAGI RLQQTANTLGLTIDSRLRIM VPDEKEDDDPYMEFVSD (SEQ ID NO: 554) | 155 | hypothetical protein PVL_01 [Staphylococcus phage PVL] | NP_058440.1 | 3e-85 (155/155) | terminase small subunit | Terminase_4, phage terminase, small subunit | pfam06119 | 2e-18 |
| 2 | 528 | 2222 | MTDYVTKYAKKVVSGEILA SLKNIQVCKRFILSFMENPP NGCHWDNHLSNKAIKFVE MLPDPKTNQPMPLMEFQK FIVGSLYGWRRGQYRMFT KAYISMARKQGKSLIVSGM SVNELLFGQYPKFNRQIYV ASSTYKQAQTIFKMASQQV NLMRSKSKFIREKTDVRKT DIEDVLSSSVFAPLSNNPDA VDGKDPTVAILDELASMPD DEMYSRFKTGMTLQKNPLT LLVSTAGDNLNSQMYQEYK YIKRILNEEVRADNYFVYCA EMDSQEEVQDETKWIKAM PLLESKEHRKTILQNVKADI QDELEKGTSYHKILIKNFNL WQAQREDSLLDISDWEQVI TPMPNINGKDVYIGVDLSRL DDLTSVGFIFPNDDKKVFLH SHSFIGLRTNLEQKSKRDKI NYELAIERGEAETTQSDSG MIDYKQVIDFIVKFITTHDLN VQAVCYDPWNAQSFITTIE SMALDWPLIEVGQSFKALS QSIKEFRMWVADERIGHND NMLLTSVNNAVLIRDGED NVKINKKMNRQKIDPIISIITA | 564 | phi PVL ORF 2 homologue [Staphylococcus prophage phiPV83] | NP_061528.1 | 0.0 (564/564) | terminase large subunit | Terminase_1, phage terminase | pfam03354 | 2e-169 |

FIG. 14A

| | | | | | | |
|---|---|---|---|---|---|---|
| 3 | 2197 | 2436 | FTEARMHEFQENWTEKYE SEEFGF (SEQ ID NO: 555) MKAKNSDFKGGDKMDLNKI NVFFNFLVANLVSILFLLGLF VVNVSMYKAFGQNIGLLCI GITLMSLILNHESNQERS (SEQ ID NO: 556) | phi PVL orf 3-like protein [Staphylococcus phage phi13] | NP_803385.1 | 1e-35 (78/79) | | No putative conserved domains have been detected |
| 4 | 2442 | 3692 | VGIFYKNEKRDLQYNEDDL QMMVQTLPGFQGTKLRQY KDIEAIRHSDIFTAVMMIASD LARMPIRVTVNGQINYSDRI VNLLNTRPNPMYNGYIFKL VVFVSALLTSHGYIETTRDK TGEPMNLTFRKTSEIELKSD ARGRLYYFHQRIDSNGNNI ERNVKFEDMLDIKFYSLDGI NGLSLLDTLSRTIESDNNGK DFLNNFLRNGTHAGGIILKM KGVLDNKKARDRAREEFH KBFSGTKQAGKVVVLDES MTFDQLEVDTEVLKLIRENK SSTREIAGVFGIPLHKFGIET ANMSITDANLDYLSTLKPYI TCVCAELNFKFNDEYVNRE FKFDTTEIRVVDEKTQAEID KINIDSGKMNIDEIRQRDGL APIPGGNGSIHRVDLNHVNI ELVDEYQMNKSRATDKKLK GGEENE (SEQ ID NO: 557) | portal protein [Staphylococcus phage phi13] | NP_803386.1 | 0.0 (416/416) | portal protein | Phage portal protein | pfam04860 | 2e-78 |
| 5 | 3685 | 4269 | MSKETRVGNIIEVRSNDNN EMMEGYALKFDTWSENLG GFKETSRRALENTDLSDV RCLVDHIPSQIIGRTKSGTL ELETDDVGLIKYRCKLPNTT FARDLYENMRVGNINQCSF GFMLDDKGDEVRFDEQENI YKRTLTAIRELTDVSVVTYP AYKDTDVKPALRSIETVKKE QRKKELEIRLKKHSILNNIIW (SEQ ID NO: 558) | putative prohead protease [Staphylococcus aureus subsp. aureus MSSA476] prohead protease [Staphylococcus phage phi13] | YP_044002.1 NP_803387 | 4e-110 (194/194) 9e-110 (194/194) | prohead protease | Peptidase_U 35, caudovirus prohead protease | pfam04586 | 1e-43 |

FIG. 14B

| | | | | | | | |
|---|---|---|---|---|---|---|---|
| 6 | 4357 | MKTKEELQSEISDIKRQIDL KVKYATRALNNDELEKAEK LEQEITDLRSQIQEKQEELD KLKEKDGTSENNQQSVEV NEARTYRNQANINDLGISIQ NTKVTSQEVRDFTEYLETR NDIQGGSLKTDSGFVVIPEE IVTDILKLKEVEFNLDKYTV KRVTNGSGKYPVWRQSEV AALEKVEELEENPELAVKP FFQLAYDINTHRGYFRISRE AIEDAKVNVLQELKLWMAR TIAATRNKAIIDVITKGSTGS TSSGFEKEGKKLEVKKAKS LDDIKDAINLNVKPNYEHNV AIVSQTMFAKLDKMKDKLG NYLIQPPDVKEKTQQRLLGA KIEILPDEVLGQKGNNTLIIG NLKDAIVLFDRSQYQASWT DYMHFGECLMIAVRQDCRI LDYKSAIMEYDDSERGEGD LGLEA (SEQ ID NO: 559) | 5604 | putative capsid protein [Staphylococcus phage phiPVL108] | YP_918931.1 | 0.0 (415/415) | capsid protein | Phage capsid family | pfam05065 | 6e-60 |
| 7 | 5640 | MAMYEVKKSYTDLEKGQY LKSGKRVEMTVKRAEYVNK KLKEHGVILERVKEE (SEQ ID NO: 560) | 52 | hypothetical protein PVL_07 [Staphylococcus phage PVL] | NP_058446.1 | 2e-20 (52/52) | | No putative conserved domains have been detected |
| 8 | 5807 | MQLTAEELKLLKKHCKIDH NSEDDLLEIYYSWAFHEIAS AVTDEPSKYIDWFKSHPLF ARAIYPLASYYFENRIAYLD RDLSLAPHMVLSTVHKLRG SFEQFLESENDEI (SEQ ID NO: 561) | 6139 | hypothetical protein MW1902 [Staphylococcus aureus subsp. aureus MW2] | NP_646719.1 | 3e-58 (110/110) | DNA packaging | Phage QLRG family, putative DNA packaging | pfam05135 | 4e-29 |
| | | | 110 | DNA packaging protein [Staphylococcus phage phiPVL108] | YP_918932.1 | 1e-57 (109/110) | | | |
| 9 | 6126 | MMKFNSNKLNERIDFCEDV SERVNGNPMKPKTKILYSC FACIQESKESDTQTNLNTG SKFIKTIIRDTRGDYKPTNK HYVLHEGQRFNIKYVKPDY QDKSYLRIYGEVVI (SEQ ID NO: 562) | 6461 | putative phage head tail adapter [Staphylococcus phage tp310-1] | YP_001429877.1 | 2e-59 (111/111) | Head tail adapter | No putative conserved domains have been detected |

FIG. 14C

| | | | | | | |
|---|---|---|---|---|---|---|
| 10 | 6461 | 6838 | MGARIESNNIEQGLKNAVL KMNLNSNVIVKAGAMSLVP LLKSNTPFADTKKHARDHIA VSNVKTDRDTSEKIVTIGYA KGVSHRIHATEFGTMYQKP QLFITKTEKQGKNKVLKTML DTAKRLQK (SEQ ID NO: 563) | phi PVL ORF 11 homologue [Staphylococcus prophage phlPV83] | NP_061636.1 | 2e-65 (123/125) | head-tail joining protein | No putative conserved domains have been detected |
| | | | | head-tail joining protein [Lactobacillus phage Lrm1] | YP_002117677.1 | 4e-05 (38/115) | | |
| 11 | 6835 | 7215 | MINVTKIIRNAIIANNITDEVN VFNYTIDDHFHEKTDKPIIRI YPLPFNPDTYADDNEISRE YHYQIDVWWSQDEPNEQA EKIVELLKVINFQCYYREPL YESDVMSFRHIIRAKGSILS MKLEEN (SEQ ID NO: 564) | 128 | phi PVL orf 12-like protein [Staphylococcus phage phi13] | NP_803393.1 | 1e-67 (125/126) | structural protein | No putative conserved domains have been detected |
| | | | | structural protein [Bacillus phage Fah] | YP_512319.1 | 1e-04 (27/79) | | |
| 12 | 7216 | 8169 | MIEKLKQAPRFLKLNLQHFA DTGVSGIAIGVSNFYYAPIL KDTENEWETGAGTRIRFLK EIEVDRPQDTEEDYGDDMV AATAVSNGKLSVKTTFVTV PADDKAFLNGAKKGVGGY KYGAKDIPPDVAIVFERRNH DESSEWWGLFKGKFTRSSI KGQTKQDKVEFQNDDVEG NFIDRLFDESSHVTGYDKK GSTTGRDYVFMETFGKTY DEFMSSRGEQNMEPVEKE MKKTEKVEVTSVNVTDEQV TVKVDATKQLSATTEPSGQ KVTYAVTEGQTYASVTSTG LVKGLAEGNATVTATAGKQ TDTVQITVQSNLEM (SEQ ID NO: 565) | 317 | phi PVL orf 13-like protein [Staphylococcus phage phi13] | NP_803394.1 | 0.0 (317/317) | major tail protein | Bacterial Ig-like domain (group 2) | pfam02368 | 8e-08 |
| | | | | putative phagelike major tail protein [Bacillus pumilus ATCC 7061] | ZP_03055808.1 | 5e-08 (51/181) | | |

FIG. 14D

| | | | | | | | |
|---|---|---|---|---|---|---|---|
| 13 | 8234 | 8680 | MERTSIELITGFTKTGKPQY QKYLAKPIITLFETIQGSKLG LKLNKAFKGADFKDLTEEE FNNLSVTEQEEYKNKQEEY ENNMAVQMEVLEEVLDFIV EAFDNQFTSIELQKGLPNG QEGIEKIGQLIGRITGGEPS DTKKFVTENQK (SEQ ID NO: 566) | 148 | phi PVL ORF 14 homologue [Staphylococcus prophage phiPV83] | NP_061639.1 | 5e-78 (148/148) | No putative conserved domains have been detected |
| 14 | 8918 | 13567 | MPNPIGNMVIKVDLDGSGF NRGVTGLNRQMKMVSREL SANLSQFSRYDNSLEKSKI KVEGLSKKQKVQAQITKEL KDSYDKLSKETGENSAKTQ AAAAKYNEAYAKLNQYERE LNQATQELKDMQREQKAL NTAMGKLGTNFNNFGPKL QEIGNSMKNVGRNMTMYV TAPVVAGFAVAAKKGIEFD DSMRKVKATSGATGEEFE ALKKAREMGATTKFSASD SAEALNYMALAGWDSKQM MEGLSGVMDLAAASGEEL GAVSDIVTDGLTAFGLKAK DSGHFADVLAQTSSKANTD VRGLGEAFKYVAPVAGALG YTIEDTSIAIGLMSNAGIKGE KAGTALRTMFTNLSSPTRA MGNEMERLGISITDSNGKM IPMRKLLDQLREKFKHLSK DQQASSAATIFGKEAMSGA LAIINASDEDYQKLTKSIDSS TGASKRMADTMESGLGGK LRTLRSQLEEILALTIYDRIEP ALKIVSAFSKVVTWTKLP TSIQLAVVGFGLFAAVLGPL VFMFGLFISVMGNAMTVLG PLLINVNKAGGIFAFLRTKIA SLVKLFPILGVSISSLTLPITL IVGALVGIGIAFYQAYKRSE TFRNIVNQASGVANAFKAA KLALQGFFDLFKGDSKGAV TLEKIFPPETVAGIQNYVVNTI | 1549 | tail length tape measure protein [Staphylococcus phage tp310-1] | YP_001142888.1 | 0.0 (1534/1550) | tail length tape measure protein | Phage-related protein [Function unknown] | COG5412 | 2e-124 |
| | | | | | | | | Lytic transglycosylase (LT) and goose egg | cd00254 | 8e-07 |

FIG. 14E

FIG. 14F

| | white lysozyme (GEWL) domain |
|---|---|
| RTTFFKVVDAIVGFAKEIGA QLASFAKENGSSEITQALQN IAGFIKATFEFIFNFIIKPIMFA IWQVMQFIMPAVKALIVST WENIKGVIQGALNIILGFIKF FSSLFTGNWRGVWDGIVMI LKGTVQLIWNLIQLWFVGKI LGVVRYFGGLLKGLISGIWS VIKGIFTKSLSAIWNATKSIF GFLYNSVKSIFTNMKNWLS STWNNIKSNTVGKAHSLFT GVRSKFTSLWNATKDIFTK LRNWMSNTWNSIKDNTVGI AGRLWDKVRNIFGNMRDG LKSIIGKIKDHIGGMVDAIKK GLNKLIEGLNWVGGKLGM DEIPRLHTGTEHTHTTRLV KNGKITRDTFATVGDKGRG NGPNGFRNEMIEFPNGKR VITPNTDTTAYLPKG8KVYN GAQTYSMLNGTLPRFSIGT MWKDIKSGASSAFNWTKD QIGKGTKWLGDKVGDVMD FIDNPGKLLNYVLQAFGVD FSSLTKGMGIAGDITKAAW SKIKKSAIKWLEDAFAESGD GGVLDMNKLRYLYGHTAA YTRETQRPFHEGLDFDYIY EPVPSTINGRAQVMPFHNG GYGKWVKVKGALEVIYAH LSKYKVKTGQQVRVGQTV GISGNTGFSTGPHLHYEMR WNGRHRDPLPWLRKNNG GGKSTPGGNGAANARRAI KAAQNILGGRYKA3WITNE MMRVASRESNYTANAVNN WDSNARAGIPSRGMFQMI DPSFRAYAKSGYNNPLNPT HQAISAMRYfVGKWPRTG SWRAAFKRAGDYAYATGG KVYNGLYHLGEEGYPEWMI PTDPSRANEAHKLLALAAN DIDNRSKNKRPNNLPNPSIS | |

| 15 | 13567 | NSDTNYIHTLENKLDAVINC LVSLVESNQMIADKDYEPVI NKYVFEDEVNNSIDKRERH ESTRVRFRRGGTII (SEQ ID NO: 567) | | | hypothetical protein MW1894 [Staphylococcus aureus subsp. aureus MW2] | NP_646711.1 | 0,0 (496/496) | | |
| | 15057 | MQDTIQIDNKTIEMLVVQR GFEIPSFNFVTEKESVKGR TGSIAKARYLNDIEFELPLII RNEVLAPGGQKTHDDILEE LVEFFDIDNLKPKKLKFKSQ NWYWFAYFDGPLKLPKNP RGSVKFTIKVVLTDPYKYSV TGNKNTAISDQVSVVNSGT ADTPLIVEARAIKPSSYFMIT KNDEDYFMVGDDEVTKEV KDYMPPVYHSEFRDFKGW TKMITEDIPSNDLGGKVGG DFVISNLGEGYKATNFPDA KGWVGAGTKRGLPKAMTD FQITYKCIVEQKGKGAGRT AQHIYDSDGKLLASIGYENK YHDRKIGHIVVTLYNQKGD PKKIYDYQNKPIMYNLDRIV VYMRLRRVGNKFSIKTWKF DHIKQPDRRKPIDMDEKEW IDGGKFYQRPASIIAIYSAKY NGYKWMEMNGLGSFNTEI LPKPKGGARDVIIQKGDLVKI DMQAKSVVINEEPMLSEKS FGSNYFNVDSGYSELIIQPE NVFDTTVKMQDRYL (SEQ ID NO: 568) | 496 | | phi PVL orfs 18-19-like protein [Staphylococcus phage phi13] | NP_803397.1 | 0,0 (481/495) | tail protein | No putative conserved domains have been detected |
| | | | | | phage tail fiber protein [Staphylococcus aureus subsp. aureus str. Newman] | YP_001333292.1 | 0,0 (441/496) | | |

FIG. 14G

| 16 | 15073 | 18855 | VIHVLDFNDKIIDFLSTDDPS LVRAIHKRNVNDNSEMLEL LISSERAEKFRERHRVIIRD SNKQWREFIINWVQDTMD GYTEIECIASYLADITTAKPY APGKFEKKITSEALKDVLSD TGWEVSEQTEYDGLRTTS WTSYQTRYEVLKQLCTTYK MVLDPYIELSSNTVKGRYV VLKKKNSLFKGKEIEYGKDL VGLTRKIDMSEIKTALIAVG PENDKGKRLELVVTDDEAQ SQFNLPTRYIWGIYEPQSD DQNMNETRLRSLAKTELNIK RKSAVMSYEITSTDLEVTYP HEIISIGDTVRVKHRDFNPP LYVEAEVIAEEYNIISENSTY TFGQPKEFKESELREEFNK RLNIIHQKLNDNISNINTIVK DVVDSELEYFERKIHKSDT PPENPVNDMLWYDTSNPD VAVLRRYWNGRWEETPN DVEKLGGITREKALFSELNN IFINLSIQHASILSEATELIN SEYLVDNDLKADLQASILDA VIDVYNQIKNNLESMTPETA TIGRLVDTKTLFLEYRKKLQ DVYTDVEDVKIAISDRFKLL QSQYTDEKYKEALEIIATKF GLTVNEDLQLVGEPNVVKS AIEAARESTKEQLRDYVKT SDYKTDKOGIVERLDTAEA ERTTLKGEIKDKVTLNEYRN GLEEQKQYTDDQLSDLSN NPEIKASIEQANQEAQEALK SYIDAQDDLKEKESQAYAD GKISEEEQRAIQDAQAKLE EAKQNAELKARNAEKKANA YTDNKVKESTDAQRKTLTR YGSQIIQNGKEIKLRTTKEE FNASKRTLSRVLADITVNA MK3IYLRYDENGAITSHTID | hypothetical protein SA1764 [Staphylococcus phage phiN315] | NP_835566.1 | 0,0 (1249/1260) | | structural protein | pfam06519 and PRK01156 | 3e-05 and 5e-04 |
|---|---|---|---|---|---|---|---|---|---|
| | | 1260 | | | | | | | |
| | | | structural protein [Staphylococcus phage phiPVL108] | YP_918942.1 | 0,0 (1215/1224) | | TolA protein and chromosome segregation protein | | |

FIG. 14H

| | | | | | | | |
|---|---|---|---|---|---|---|---|
| 17 | 18848 | 19000 | KDGVKISGDKVDITANREF NVVAMNINNKVGKNDIVNS LNLSNEGLDINVNRIGIKGG NANRYVQVQNDFIELGGGIV QRTWKGKRSTDDIFTRLKD GHLRFRNNTAGGSLYMSH FGISTYIDGEGEDGGSSGTI QWWDKTYSDSGMNGITIN SYGGVVALTSDYNRIIIDSY ASANIESREAPIYLSFNTKN KPGLNRFAFTLSNADSAYE TDGYIMFGSDENYKYGAGL RFSKRSNKGLVQVVNGDY ATGGDTTIESGMGKFNIVK RRDGNSYVSIQSYDLLAVG SDNAGDRVASNSIYKRTYS APANLHTSAGTIGRATSAK KYKISIENQYINEDDQFSHS KEILKLPIRTWFDKYESEIM AKELESGKKLSDDTFKLSR HTGLIAEEVEELGFNEFVIY DDNGEIEGIAYDRLWVHLIP IIKNQQSKIEKLEELINE (SEQ ID NO: 569) MNDSNQGLQANPQYTHYLSQ EITRLTQENAMLKAYIQEQNEK SKSAEEE (SEQ ID NO: 570) | 50 | hypothetical protein SAS061 [Staphylococcus phage phiN315] | NP_835567.1 | 2e-20 (50/60) | No putative conserved domains have been detected |
| 18 | 19046 | 19333 | MANEIIKKTERFILVLVQIDKEG TERVLYQDFVGSFTTSDSA SYAQDFKSEENAKKIAETL NLLYQLTVNQNGVKVKEV VDRTDLSSDKSVDSEIM (SEQ ID NO: 571) | 95 | hypothetical protein SAS1874 [Staphylococcus aureus subsp. aureus MSSA476] | YP_043988.1 | 1e-45 (93/95) | |
| | | | | | hypothetical protein SABPV108_gp53 [Staphylococcus phage phiPVL108] | YP_918943.1 | 2e-45 (93/95) | No putative conserved domains have been detected |

FIG. 14I

| | | | | | | | | |
|---|---|---|---|---|---|---|---|---|
| 19 | 19389 | LDDIQKIKKELSELVERVDDVEI LANETADHVLELREEHKQHHN ELRESHKELKDKDDKVVDENIL EQTKILNRIEERYQTQVDVAQK NEEKTLAQNKWLVGAIWALVTI VMIAVMTASITALLP (SEQ ID NO: 572) | 124 | hypothetical protein SA1762 [Staphylococcus phage phiN315] | NP_895669.1 | 2e-62 (123/124) | | Ligand-gated ion channel family (belongs to the PSPb superfamily) | pfam02080 | 0.002 |
| | 19763 | | | | | | Zinc finger-containing protein | pfam10148 | 0.004 |
| 20 | 19948 | MLALLKSLERRCLMITSTM LQFGLFLIALIGLVIKLIELSN KK (SEQ ID NO: 573) | 44 | ORF087 [Staphylococcus phage 42E] | YP_239882.1 | 2e-13 (43/44) | | No putative conserved domains have been detected | |
| 21 | 20294 | MINWKIRMKQKSFIWVAILS AIFLFAQNIAKAIGYDIQVYT EQLTDGLNAILGFLVLTGVI QDPTTKGIGDSHQALEYEE PRRKY (SEQ ID NO: 574) | 84 | holin [Staphylococcus phage phi13] | NP_803401.1 | 2e-42 (84/84) | holin | Phage_holin_1, bacteriophage holin | pfam04531 | 1e-32 |
| 22 | 20548 / 21327 | MKTYSEARARLRWYQGRY IDFDGWYGYQCADLAVDYI YWLLEIRMWGNAKDAINND FKNMATVYYENTPSPVPQIG DVAVFTKGIYKQYGHIGLVF NGGNTNQFLILEQNYDGNA NTPAKLRWDNYYGCTHFIR PKYKSEGLMNKITNKVKPP AQKAVGKSASKITVGSKAP YNLKWSKGAYFNAKIDGLG ATSATRYGDNRTNYRFDV GQAVVAPGTLIYVFEIIDGW CRIYWNNHNEWIWHERLIV KEVFSFLG (SEQ ID NO: 575) | 255 | amidase [Staphylococcus phage phi13] | NP_803402.1 | 2e-146 (251/251) | CHAP endolysin | CHAP domain | pfam05257 | 9e-18 |
| 23 | 20560 / 21506 / 21997 | MLKRSLLFLTVLLLLFSFSSI TNEVSASSSFDKGKYKKGD DASYFEPTGPYLMVNVTGV DGKGNELLSPRYVEFPIKP GTTLTKEKIEYYVEWALDAT AYKEFRVVELDPSAKIEVTY YDKNKKKEETKSFPITEKGF VVPDLSEHKNPGFNLITKV VIEKK (SEQ ID NO: 576) | 163 | Staphylokinase [Staphylococcus phage tp310-3] | YP_001430018.1 | 9e-88 (163/163) | staphylokinase | Staphylokinase / Streptokinase family | pfam02821 | 1e-17 |

FIG. 14J

| | | Sequence | | | | | | |
|---|---|---|---|---|---|---|---|---|
| 24 | 22777 | VRDGYSTNSRITGVLPNNA TIKYDGAYCINGYRWITYIA NSGQRRYIATGEVDKAGN RISSFGNFSAV (SEQ ID NO: 577) | 68 | amidase [Staphylococcus phage tp310-1] | YP_001429893.1 | 1e-31 (87/68) | cell wall hydrolase remnant | SH3_5, bacterial SH3 domain / pfam08460 / 4e-05 |
| 25 | 22983 | MKIRKSILAGTLAIVLASPLV TNLDKNEAQASTSLPTSNE YQNEKLANELKSLLDELNV NELATGSLNTYYKRTIKISG LKANIWFLIIFVLTVLVFNPLI VKFIIWLINETRKFMNLDCIS LLDKRDKLFNNNGKPVFIVI KDFENRIIEEGELKTYNSAG SDFDLLEVERQDFKVSDLP SNDELYIKHTLVDLKQQIKL DLYLMNEY (SEQ ID NO: 578) | 209 | Na/K ATPase [Staphylococcus phage phi 12] | NP_803308.1 | 3e-70 (131/133) | ATPase and/or Staphylococca l Complement Inhibitor | |
| | 23495 | | | SCIN [Staphylococcus phage tp310-3] | YP_001430020.1 | 4E-38 (82/82) | | No putative conserved domains have been detected |
| 26 | 24124 | LNGGENFMADKNKKQEAT RSNPINKSFEKPGASENLK STLSEKAKKKD (SEQ ID NO: 579) | 48 | hypothetical protein SAOUHSC_01579 [Staphylococcus aureus subsp. aureus NCTC 8325] | YP_500095.1 | 4e-18 (47/48) | | |
| | 24267 | | | ORF136 [Staphylococcus phage 47] | YP_240032.1 | 7e-14 (41/41) | | No putative conserved domains have been detected |
| 27 | 24121 | MKITNCKIKRETIVVEVLTS GNQPFTYELPKDLSSHNAR KYLEFISQKIDGDKLTKEDS L (SEQ ID NO: 580) | 60 | hypothetical protein SaurJH9_2058 [Staphylococcus aureus subsp. aureus JH9] | YP_001247417.1 | 1e-27 (60/60) | | |
| | 24303 | | | hypothetical protein phi12p03 [Staphylococcus phage phi 12] | NP_803309.1 | 4e-27 (59/60) | | No putative conserved domains have been detected |

FIG. 14K

| | | | | | | | |
|---|---|---|---|---|---|---|---|
| 28 | 25030 | 24689 | MIKKIFTKKHVFLVIEDENH NHSDAVFGKSILLSIYVGVN KKTNSKSGKFIYLDRSKRIV RQSDITKIESANENDVDFYN LLKKEKEIVYSKNIVDKYNL ANYIYYEVSTKE (SEQ ID NO: 581) | hypothetical protein NM3_gp04 [Staphylococcus aureus phage phiNM3] | YP_908793.1 | 3e-56 (113/113) | | No putative conserved domains have been detected |
| 29 | 25968 | 25036 | MKKYDIAVLDFETMNEHMN SPCEVAVSLIKDLSIVKVYS SYINPPNNRYNLKNAKIHKI PEDVILKAPKYPDIYQEILYL LKESHLIIAHNALFDISVLKN TNNYYDLPVPNFMYVDSINI FRSFHAISSFKLENLCSLYD IDKEKLIHSAKFDVLALSKML ISLAKNNQHYSVLKLIHYMP KQYIRFSKYSNSPTKLFDS GFQKIHMKISEINKIEVESVI PILKDKNVVFTGNFDTEKQ TDILVEGVQDDKYKDVNGL VSKQRKAREYVGNGAKIQF LNEEDLINLIKE (SEQ ID NO: 582) | Pol III-like ATP dependent helicase [Staphylococcus phage phi12] | NP_803310.1 | 4e-177 (310/310) | ATP-dependent helicase | DNA polymerase III subunit epsilon PRK03195 1e-35 |
| 30 | 26697 | 25984 | MNKERNIIIAKNIRKFLNDSN MSQKKLAELINIKPSTLSDY LNLRSNPSHGVIQRIADVFE VGKSDIDTTYKDDNDITSIY NKLTPPRQENVLNYANEQL EEQNSKGADNVVDINSYKQE KTPVNVNGCVSAGVGERL HDETLFTEMVKGPIPTHDL ALKVNGDSMEPMFKDGEII FVEKTHNIKNGQIGIFIIEEE AYVKKVFVEDDRLTLVSLN KDYDDLHFYRNESVRLIGK VIL (SEQ ID NO: 583) | hypothetical protein SA1805 [Staphylococcus aureus subsp. aureus N315] | NP_375106.1 | 3e-134 (237/237) | cI-like repressor | Peptidase S24 LexA-like proteins cd06529, | 9e-16 |
| | | | | cI-like repressor [Staphylococcus phage 11] | NP_803258.1 | 5e-38 (96/240) | | LexA repressor PRK00215 | 2e-09 |
| 31 | 26830 | 27093 | MKTLKELRTDYGLTQKELG DLFKVSSRTIQNMEKDSTNI KDSLLSKYMSAFNVKYDDI FLGNEYENFVFTNDKKKSII LAFKEKQTS (SEQ ID NO: 584) | transcriptional regulator [Staphylococcus phage phi 12] | NP_803312.1 | 5e-42 (87/87) | cro-like repressor | Helix-turn-helix XRE-family like proteins cd00093 | 6e-07 |

FIG. 14L

| | | | | | | | |
|---|---|---|---|---|---|---|---|
| 32 | 27109 | 27324 | MNIQVATKLAMEKGISIRRE NQDVYGILPTNLQRYQCLV VSRHYKKRQTAAGRWQP SADDLIADDWILDY (SEQ ID NO: 585) | | hypothetical protein NM3_gp08 [Staphylococcus aureus phage phiNM3] | YP_908797.1 | | | No putative conserved domains have been detected |
| 33 | 27642 | 27313 | MTDEAKFVLLQLYSIYLDRI DEGMSKRSASYFGSDESS FNAFFLGFNFEDYIDAVLEL KHRDFVIASAEDGGFLEMA LSREGIAYSESESKKDYKTL MGLIRDLKKLII (SEQ ID NO: 586) | 109 | hypothetical protein NM3_gp09 [Staphylococcus aureus phage phiNM3] | YP_908798.1 | 2e-54 (109/109) | | Uncharacterized protein conserved in bacteria (DUF2064) | pfam09837 | 0.005 |
| 34 | 27693 | 28445 | MQALQTKSNIGEMFNIQEK ENGEIAISGRELHQALEVKT PYKKWFERMSDYGFEENID YIVTDIFVHNPLGGRQNQT DHALTLDTAKEIAMIQRSEP GKRARQYFIQVEKAWNSP EMIMQRALKIANNTINQLET KIERDKPKIVFADAVATTKT SILVGELAKIIKQNGINIGQR RLFEWLRQNGFLIKRKGVD YNMPTQYSMERELFEIKET SITHSDGHTSISKTPKVTGK GQQYFVNKFLGEKQTS (SEQ ID NO: 587) | 250 | anti repressor [Staphylococcus phage phiN315] | NP_835526.1 | 2e-145 (250/250) | antirepressor | ANT, phage antirepressor protein KilAC domain | pfam03374 | 7e-36 |
| 35 | 28461 | 28658 | MQAQNKKVIYYYDEAGN RRPVNIQYNDGYDLMIDPR FIEMTLERHPHLKNNFYGLI DGKEFKLD (SEQ ID NO: 588) | 65 | phi PVL orf 35-like protein [Staphylococcus phage phi13] | NP_803363.1 | 1e-30 (65/65) | | No putative conserved domains have been detected |
| 36 | 28669 | 28829 | MLQKFRIAKEKNKLKLLK HASYCLERSNNPELLRAVA ELLKVN (SEQ ID NO: 589) | 46 | hypothetical protein MW1930 [Staphylococcus aureus subsp. aureus MW2] | NP_646747.1 | 1e-16 (46/46) | | No putative conserved domains have been detected |
| | | | | | ORF124 [Staphylococcus phage 88] | YP_240709.1 | 1e-10 (36/46) | | |

FIG. 14M

| | | | | | | | |
|---|---|---|---|---|---|---|---|
| 37 | 29476 | VVIDPLKNVRFSINNVISNV EISKSMAIKQSLKPKYQLDII NRNNINLFSDFKVDFHLNN LIEMNFNLRNSFSSLTFQR NLFSEETIKSFKELYRFDDE IVLQAQQTIRDFYINPTAIST LAEAINSTYPINEQSTYKRH DEFVKRIENDFPHPFKKLIR WSNGIAAGADIQIFVTNYIN ENDLHIQNSLIVAIVCLLSFL STYCSHSKK (SEQ ID NO: 590) | | hypothetical protein SAV1992 [Staphylococcus aureus subsp. aureus Mu50] | NP_372516.1 | 1e-117 (210/210) | | No putative conserved domains have been detected |
| | 28844 | | 210 | hypothetical protein NM3_gp12 [Staphylococcus aureus phage phiNM3] | YP_908801.1 | 4e-117 (209/210) | | |
| 38 | 29535 | MPHILNVTVPIPETHVLITKD EYDELIGYSLDPVWNMSDL KKKLKASDETIKDRLLFHP RFEKELRAQGIVHYPDENF NRVMRFNARKMNKFVDEHF NEIYKERIK (SEQ ID NO: 591) | 106 | hypothetical protein NM3_gp13 [Staphylococcus aureus phage phiNM3] | YP_908802.1 | 9e-56 (106/106) | Domain of unknown function (DUF771) | pfam05595 | 3e-33 |
| 39 | 29852 | MSNIYKSYLLAVLCFTVLAIV LMPLLYFTTAWSIAGFASIA TFIFYKEYFYEE (SEQ ID NO: 592) | 53 | ORF105 [Staphylococcus phage 71] | YP_240424.1 | 2e-21 (53/53) | Protein of unknown function (DUF1270) | pfam06900 | 4e-11 |
| 40 | 30010 | MKKLLLAPTSNSDKRLTKLI HFQVKTKNGGSQL (SEQ ID NO: 593) | 33 | hypothetical protein NM3_gp15 [Staphylococcus aureus phage phiNM3] | YP_908804.1 | 3e-10 (33/33) | | No putative conserved domains have been detected |
| 41 | 30108 | MTKNYKDMTQEELRDLLAE KNGELFEVVNEINKETEFAV LLFSTVGVSNGDTTSSSHC ALGDIVGLANLLNNENDYH DIANVIEMYKLKLKLLGLADN KEDENDVLQNG (SEQ ID NO: 594) | 108 | hypothetical protein NM3_gp16 [Staphylococcus aureus phage phiNM3] | YP_908805.1 | 2e-54 (108/108) | Hypothetical protein of unknown function (DUF2482) | pfam10655 | 3e-40 |

FIG. 14N

| | | | | | | | |
|---|---|---|---|---|---|---|---|
| 42 | 30415 | MYYKTGDVCQKIINVDGFD FRLRVKKRAYSVEIVVLDHE GNSIDGILVSDENDLYTALD ILKQSIYEMIENNTDEQDKL MNLVMKW (SEQ ID NO: 595) | 86 | hypothetical protein NM3_gp17 [Staphylococcus aureus phage phiNM3] | YP_908806.1 | 1e-42 (86/86) | Protein of unknown function (DUF1108) | pfam06531 | 2e-35 |
| 43 | 30684 | MRDTERNILNIFKTLFDEYT LSNQRALLEIERNHHGYLSI NFLHYHDSYKTNNKLVQIH EINPDSHERIKNLIIEVLRGH RKIKKGA (SEQ ID NO: 596) | 87 | hypothetical protein NM3_gp18 [Staphylococcus aureus phage phiNM3] | YP_908807.1 | 4e-43 (87/87) | No putative conserved domains have been detected | | |
| 44 | 30956 | MKINKLTISNFAGIKEVTFNF DGKDAKIYGNNATGKTTTA TALQWLLFDKGLDGSTKSF NPVPLNEKNAENYELIPTVF AEFEIDGKITTFKKESHPKY TINQKTNRKEYSRSRTKKQ YINDESIKVKDYKARIDELID EDVFKLITNPQAFNLLDWK KRRSLLFEIAKPINDEDVIKT NDDFKELNNILGDHEIETKK KILTDKIKQINKDIKDIPIRIN QTQQNKQDVPEFDNDRYAI IKQEIEQLENERIDIQNGKE EINLRMQLADKQSELKRIED NNSASNENKIHALTNELHV ENGTVANLKTRLKQNKQQI THEENRRNQLLENHKGLKS DLEKSKNQKFEHLDDNVCS CCGQQLPTEQVNEAREKA LQKFNVKKSKELETIQTSIN HIISEGKKIKPIIEKLEDDNN NLQIKINEAEERSARIQNKIN KLKTHVDVTQTDEYKAVM LEINEINQKRSNIRKTIQDKV SGIDDKISELTQEKSEIEVS RSIEKSNKHLDDVISELRNE EDRLLDEKEKYSHDLYILKK FTTKVKMLTENINNEFDIA EFKLFNTLVNGELEETCSTT | 647 | hypothetical protein NM3_gp19 [Staphylococcus aureus phage phiNM3] | YP_908808.1 | 0.0 (646/647) | SMC_N, RecF/RecN/ SMC N terminal domain | pfam02463 | 2e-06 |

FIG. 140

FIG. 14P

| 45 | 32901 | 33821 | VNGVEYDSSGLNNASRINVG LDIINTLSKHFKVTAPIFIDNA ESVTELIKTESQQIQLIVNE QDKKLRMETI (SEQ ID NO: 597) MTENNKLQTIEQQLVQEKN VSDNVLNKVRVLESQGNLE LPNDYSPSNAMKQAWLQIS QDNKLMSCNDTSKANALLD MVTQGLNPAKNQCYFIPYG NKMQLRSYHGNVMMLKR DAGAQDVVAQVIYKGDTFK QEMGETGRIKAIKHEQDFF NIDKENIIGAYCTIVFNDGR DNYIEVMTIEQIKQAVWMQS SMIKDEKALQNSKTHNNFK EEMAKKTVINRAAKRYINTS TDSNIFKYAQESEQRQRKE VLDAEVEENANQEQLDFEQ | 306 | RecT protein [Staphylococcus aureus phage phiNM3] | YP_908808.1 | 1e-179 (306/306) | recombinase | RecT family | pfam03837 | 3e-44 |

| | | | | | | | |
|---|---|---|---|---|---|---|---|
| | | PVLEEAGYTELENDKPIDVS DFEEIKEPATEKESEEEPF (SEQ ID NO: 598) | | | | | |
| 46 | 34034 | MTAGTQQAMNFESHRLCTI KAKQELRIGTWSILPFDIEH DANEPVAFLLQSTLGYKVL YVTDTKYLKYKFNGITHMM LEVNYIYEQMQENIKNGSV HSTLANRIMESHFSLEHAIG MLKANDLTRLEEIHLIHLSS QNSNAKYIKSEIQKVTGVPV YVGGL (SEQ ID NO: 599) | 34519 | hypothetical protein NM3_gp21 [Staphylococcus aureus phage phiNM3] | YP_908810.1 | 1e-90 (160/161) | partial metallo-beta-lactamase domain | PhnP, metal-dependent hydrolases of the beta-lactamase superfamily | COG1235 | 3e-14 |
| 47 | 34520 | MINRTILVGRLTRDPELRTT QSGVNVASFTLAVNRTFTN AQGEREADFINVIVFKKQAE NVNKYLSKGSLTGVDGRLQ TRNYENKEGQRVYVTEVIA DSIQFLEPKNSNDTQQDLY QQQVQQTRGQSQYSNNK PVLDNPFANANGPIEIDDD DLPF (SEQ ID NO: 600) | 34990 | ssDNA binding protein [Staphylococcus phage PVL] | NP_058484.1 | 3e-85 (156/156) | ssDNA binding protein | single-strand DNA-binding protein | PRK06751 | 7e-41 |

FIG. 14Q

| | | | | | | | |
|---|---|---|---|---|---|---|---|
| 48 | 35920 | 35913 | MTGWSIDRSIQNHWLFKE KRTFSKFEAWYLLMEANH SKAKVPIGNQIVTVERGQR LTSILTLSDLFNWSRFKVKT FLDLLESDGMLEVKTTSKY TLITVNYDFYQSEQGRNQ HQNDIKPTSKQHQSNINPT SKQHQTNTNINDNKDNNE KNVNNEKKKVTAFDFFQDN GFGFITPYNLDDLNYYLDSF ENDSDQIVTASLKIAKDRNK VTWGYAKSILNTWLNANLK SIEQVRAFEKQQLESKKQN YKPFVKQSKEKTPKWLTDS TRETKTPEVDENLEKDREA FIKRLNSKWE (SEQ ID NO: 601) | 297 | hypothetical protein PVL_46 [Staphylococcus phage PVL] | NP_058485.1 | 1e-171 (297/297) | primosome component | DnaD, putative primosome component and related proteins | COG3935 | 2e-41 |
| 49 | 36135 | 36138 | MDAFQKYYLFDHDGNKMF SVTPHFKDGRHLVVGLKHT KFNGRRWYLDDYELKTLID NEQMELGHQTSLFEYI (SEQ ID NO: 602) | 72 | hypothetical protein PVL_47 [Staphylococcus phage PVL] | NP_658486.1 | 3e-35 (72/72) | | No putative conserved domains have been detected | |
| 50 | 36551 | MRDYMEIEIKFNEVFNAPM GSPRPRFRNTGRYAHTYM PTKYTEHKKYLQNQMPKLN LENALKIELEFYFPLLKSIWS KKKKNEMVGQYKVTKPDID NLIKTVLDACNGHLVWKDDN QITEITSSKRYGIEPKIIIRIEE I (SEQ ID NO: 603) | 138 | hypothetical protein PVL_48 [Staphylococcus phage PVL] | NP_058487.1 | 5e-73 (132/134) | endodeoxy- ribonuclease | Endodeoxy- ribonuclease RusA | pfam06866 | 2e-23 |
| 51 | 36564 | 36932 | MARKARIVTINDIKPYRFSKF EMELIESHQITAGMVSKRV KDGWELHEAMDAPEGTRL SEYREKKTIERLEQARLER KLERERKKEAELRRKKPHL FNVPQKHPRGRYACYLLEN DJFVKVKK (SEQ ID NO: 604) | 122 | hypothetical protein SAR2077 [Staphylococcus aureus subsp. aureus MRSA252] | YP_041447.1 | 5e-64 (120/122) | | PVL ORF-50-like family | pfam07768 | 4e-30 |
| | | | | | hypothetical protein PVL_49 [Staphylococcus phage PVL] | NP_058488.1 | 4e-52 (117/122) | | | | |

FIG. 14R

| | | | PVLJ | | | | | |
|---|---|---|---|---|---|---|---|---|
| 52 | 36936 | MTDNARIKEYLNQFFGFKR YLYQDNERVAKIHVVNGTY YFHGHIVPGWQSVKKTFDT AEELEYIKQIHGLEYEEQKQ LTLF (SEQ ID NO: 605) | hypothetical protein NM3_gp27 [Staphylococcus aureus phage phiNM3] | 80 | YP_908816.1 | 2e-40 (80/80) | | Phage conserved open reading frame 51 | pfam06194 | 5e-32 |
| 53 | 37184 | MEMMNAEKHMQMMQMLQ NCVIDKYVSHDEYEELIAID KHGNKMFIKFYPNTEDDTN E (SEQ ID NO: 606) | 57 | similar to phage phi PVL ORF51 [Staphylococcus phage phiETA] | NP_510923 | 1e-25 (56/56) | | No putative conserved domains have been detected | |
| 54 | 37350 | MNNREQIEQSVISASAYNG NDTEGLLKEIEDVYKKAQA FDEILEGMTNAICHSVKEG VELDEAVGIMAGQVVYKYE EEQENEH (SEQ ID NO: 607) | 83 | hypothetical protein NM3_gp29 [Staphylococcus aureus phage phiNM3] | YP_908818.1 | 1e-39 (83/83) | | Protein of unknown function (DUF1024) | pfam06260 | 9e-26 |
| 55 | 37591 | MSISVGDKVFNPETNSTLEI VQLVGDIRDTHYKLSDGSII SLIDFVVKPIHLIKEEQEND (SEQ ID NO: 608) | 60 | hypothetical protein NM3_gp30 [Staphylococcus aureus phage phiNM3] | YP_908819.1 | 3e-26 (60/60) | | No putative conserved domains have been detected | |
| 56 | 37766 | MTNTLQVRLLSENARMPER NHKTDAGYDIFSAETVVLE PQEKAVIKTDVAVSIPEGYV GLLTSRSGVSSKTHLVIETG KIDAGYHGNLGINIKNDEER DGIPFLYDDIDAELEDGLISI LDIKGNYVQDGRGIRRIYQI NKGDKLAQLVIVPIWTPELK QVEEFESVSERGAKGFGS SGV (SEQ ID NO: 609) | 180 | putative dUTP pyrophosphatase [Staphylococcus aureus phage phiNM3] | YP_908820.1 | 2e-99 (180/180) | dUTPase | dUTPase | pfam00692 | 1e-21 |

FIG. 14S

| | | | | | | | |
|---|---|---|---|---|---|---|---|
| 57 | 38345 | 38551 | VTQYLVTTFKDSTGRKHTHI TKAKSNQRFTVVEAESKEE AKEKYEKQVKRDAVIKVGQ LFENIREGGK (SEQ ID NO: 610) | 68 | similar to phage phi PVL ORF55 [Staphylococcus phage phiETA] | NP_510929.1 | 6e-31 (67/68) | | Protein of unknown function (DUF1381) | pfam07129 | 5e-08 |
| 58 | 38548 | 38934 | MIKKLKNMDGFDIFVGILSL FGITALLLVVALPIYTVASYQ NKEVHQGTTFDKYNKRQDK EDKFYIVLDDKQVIENSDLF FKGKFDSADIQARLKVGDK VKVKTIGYRIHFLNLYPVLY EVKKVDKK (SEQ ID NO: 611) | 128 | hypothetical protein phiETA_36 [Staphylococcus phage phiETA] | NP_510930.1 | 6e-66 (128/128) | | Protein of unknown function (DUF1523) | pfam07509 | 2e-05 |
| 59 | 38931 | 39080 | MIKQILRLLFLLAMYELGKY VTEQVYIMMTANDDVEAPS DYVFRAEVSE (SEQ ID NO: 612) | 49 | hypothetical protein SAS062 [Staphylococcus phage phiN315] | NP_835548.1 | 4e-20 (49/49) | transcriptional activator | Transcriptional activator RinB | pfam06116 | 2e-15 |
| 60 | 39080 | 39280 | MWITMTIVFAILLLVGSINS DRAREIQALRYMNDYLLDE VVKTKGYNGLKEYRIELKR MNNDIKK (SEQ ID NO: 613) | 66 | hypothetical protein NM3_gp35 [Staphylococcus aureus phage phiNM3] | YP_908824.1 | 3e-30 (66/66) | | Protein of unknown function (DUF1514) | pfam07438 | 4e-22 |
| 61 | 39303 | 39839 | MYNRKEIREMIDNYKWMK NIIDSKVYDNESTSIAQYGY QSAMPKAKGTTSNKVLVKV INKNKALRKYDYLINKIAFID EYEEVTTNEKDYHILQMLKQ RESHINRIMSILDIGRDNFYS RVKDIVNILYNLQTRNRHIV HIGQFGHIVQIVQIVHIGLIL MLHIVFYYNCYVAKHLYLF (SEQ ID NO: 614) | 178 | hypothetical protein MW1912 [Staphylococcus aureus subsp. aureus MW2] | NP_646729.1 | 5e-70 (131/131) | | No putative conserved domains have been detected | | |
| | | 39303 | hypothetical protein PVL_60 [Staphylococcus phage PVL] | | | NP_058499.1 | 2e-69 (130/131) | | | | |

FIG. 14T

| | | | | | | |
|---|---|---|---|---|---|---|
| 62 | 39889 | MEISKYQEIATRTHNDELNL NESITCYGLGLGLTQSTGNVT DLIKQHMFCNVFIDKGIMIN ELSEALWNIANLTNVLGINL DEIAGHSVNTLMNKPNQTI NLDNGIKQGDKVLFQGSKY LVDGSIGNLLLISNDKDDRQ VTVQDVKKVDKE (SEQ ID NO: 615) | hypothetical protein SABPV108_gp35 [Staphylococcus phage phiPVL108] | YP_918925.1 | 6e-81 (150/150) | nucleotide pyrophosphoh ydrolase | No putative conserved domains have been detected |
| | 40341 | | MazG nucleotide pyrophosphohydrolase [Chloroflexus aggregans DSM 9485] | YP_00246389 0.1 | 5e-08 (29/95) | | |
| 63 | 40348 | LSIMKRCGHPTCNVLINHN ESYCDKHKQYANENYNDL RRRNDPEYLRFYKSKTWQ NMRRIVLLEHDFICVSCGN QATMVDHIVPTKIDWAFRL DKSNLQPLCDACHNQKTK EDLKKY (SEQ ID NO: 616) | phage endonuclease [Staphylococcus phage phiPVL108] | YP_918926.1 | 3e-64 (117/117) | endonuclease | McrA, restriction endonucleas e [defense mechanisms ] | COG1403 | 3e-05 |

FIG. 14U

| Phage | Titer (pfu/ml) | Phage sensitivity (%) of STA strains (n=100) | | | | | Total of infected strains (%) |
|---|---|---|---|---|---|---|---|
| | | ++++ | +++ | ++ | + | - | |
| F36/06 | $3.0 \times 10^8$ | 0 | 19 | 22 | 21 | 38 | 62 |
| | $3.0 \times 10^6$ | 0 | 5 | 6 | 6 | 83 | 17 |
| | $3.0 \times 10^6$ | 0 | 1 | 0 | 0 | 99 | 1 |
| | $3.0 \times 10^4$ | 0 | 0 | 1 | 0 | 99 | 1 |

FIG. 15

| orf | Start position | Stop position | Product aminoacidic sequence | Size (aa) | Homologous/similar proteins | | | Predicted function | Conserved Domains | | |
|---|---|---|---|---|---|---|---|---|---|---|---|
| | | | | | Name[organism] | Acc No | E value and identity | | Name | Acc No | E value |
| 1 | 79 | 423 | MEIIVDENLVLKEKERL QVLYKDIPSNKLKVVDG LIQAARLRVMLDYMWE DIKEKGKDYDLFTQSEKA PPYERERPVAKLFNAR DAAYQKIIKQLSDLLPE EKEDTETPSDDYL (SEQ ID NO: 617) | 114 | hypothetical protein SA1778 [Staphylococcus phage phiN315] | NP_835552.1 | 3e-58 (114/114) | | No putative conserved domains have been detected | | |
| 2 | 420 | 2081 | MISNKYVDEYINLWKQ GKIILNKERIDLFNYLGK HIYSRDDVYFDEQKIED CIKFIEKWYFPTLPFQR FIIANIFLIDKNTDEAFFT EFAIFMGRGGGKNGLIS AISDFLSTPLHGVKEYHI SIVANSEDQAKTSFDEI RTVLMDNKRNKTGKTP KAPYEVSKAKIINRATK SVIRYNTSNTKTKDGG REGCVIFDEIHYFFGPE MVNVKRGGLGKKKNR RTFYISTDGFVREGYID AMKHKIASVLSGKVKN SRLFAFYCKLDDPKEV DDRQTWEKANPMLHK PLSEYAKTLLSTIEEEY NDLPFNRSNKPEFMTK RMNLPEVDLEKMAPW KEILATNREIPNLDNGM CIGGLDFANIRDFASVG LLFRKNDDYIWLGHSFV RQGFLDDVKLEPPIKE WEKMGLLTIVDDDVIEI EYIVDWFLKAREKYGLE KVIADNYRTDIVRRAFE DAGIKLEVLRNPKAIHG LLAPRIDTMFAKHNVIY | 553 | 77ORF003 [Staphylococcus phage 77] | NP_958603.1 | 0.0 (553/553) | terminase large subunit | Terminase_1, phage terminase | pfam03354 | 2e-37 |

FIG. 17A

| | | | | | | |
|---|---|---|---|---|---|---|
| 3 | 2097 | 3260 | GDNPLMRWFTNNVAV KIKPDGNKEYIKKDEVR RKTDGFMAFVHALYRA DDIVDKDMSKALDALM SIDF (SEQ ID NO: 618) MSILEKIFKTRKDISYML DLDMIEDLSQQAYVKR LAIDSCIEFVARAVAQS HFKVLEGNRIQKNDVY YKLNIKPNTDLSSDSFW QQVIYKLIYDNEVLIVVS DSKELLIADSFYREEYA LYDDIFKDVTVKDYTYQ RTFTIMQEVIYLKYNNNK VTHFVESLFEDYGKIFG RMIGAQLKNYQIRGILK SASSAYDEKNIEKLQAF TNKLFNTFNKNQLAIAP LIEGFDYEELSNGGKNS NMPFSELSELMIRDAIK NVALMIGIPPGLIYGETA DLEKNTLVFEKFCLTPL LKKIQNELNAKLITQSM YLKDTRIENGVNKKDP LQYAEAIDKLVSSGGFT RNEVRIMLGEEPSDNP ELDEYLVTKNYEKANE NGSTLKGGDEDESGD (SEQ ID NO: 619) | 387 | hypothetical protein SA1776 [Staphylococcus phage phiN315] | NP_835554.1 | 0.0 (381/395) | portal protein | Phage portal protein | pfam048 60 | 2e-45 |
| 4 | 3244 | 3981 | MKVEIKGWIVSNEDKW VYYEMLGMIDSTCPKDVL TQLEFSDEDVDNIINSNG GNLVAGSEYTHLRAHK GKVNVRITAIAASAASLI AMAGDHIEMSPVARM MIHNPSSIAQGEAKDLN HAAETLEHVGQIMAEA YAVRAGKNKQELIEMM AKETWLNADEAIEQGF ADSKMFENDNMQIVAS DTQVLSKDVLNRVTAL | 245 | peptidase S14, ClpP [Staphylococcus aureus subsp. aureus JH9] 77ORF015 [Staphylococcus phage 77] | YP_00124733 1 NP_958605.1 | 1e-139 (245/245) 1e-138 (243/245) | Clp protease | ATP-dependent Clp protease proteolytic subunit | CHL000 28 | 3e-07 |

FIG. 17B

| | | | | | | |
|---|---|---|---|---|---|---|
| 5 | 4004 | VSKTPEVNIDIDAIANKV IEKINMKEKESEIDVADS KLSANGFSRFLF (SEQ ID NO: 620) | | | | |
| | 5149 | MTINLSETFANAKNEFI NAVNNGEPQERQNELY GDMINQLFEETKLQAK AEAERVSSLPKSAQTL SANQRNFFMDINKSVG YKEEKLLPEETIDRIFED LTTNHPLLADLGIKNAG LRLKFLKSETSGVAVW GKIYGEIKGQLDAAFSE ETAIQNKLTAFVVLPKD LNDFGPAVNIERFVRVQI EEAFAVALETAFLKGTG KDQIPIGLNRQVQKGVS VTDGAYPEKEEQGTLT FANPRATVNELTQVFK YHSTNEKGKSVAVKGN VTMVVNPSDAFEVQAQ YTHLNANGVYYTALPF NLNVIESTVQEAGKVLT YVKGLYDGYLAGGINV QKFKETLALDDMDLYT AKQFAYGKAKDNKVAA VWKLDLKGHKPALEDT EETL (SEQ ID NO: 621) | 381 | 77ORF006 [Staphylococcus phage 77] | NP_958606.1 | 0,0 (381/381) | |
| | | | | major capsid protein [Listeria phage B025] | YP_001446962 .1 | 1e-111 (191/293) | major capsid protein | No putative conserved domains have been detected |
| 6 | 5169 | MVKFKVVREFKDIEHN QHKYKVGELYPAEGYN NPRVELLTNQIIKNKYDK VYIVPLDKLTKQELLEL CESLQKKASSSMVKSEI IDLLNGEDNDD (SEQ ID NO: 622) | 95 | 77ORF045 [Staphylococcus phage 77] | NP_958607.1 | 3e-47 (94/94) | No putative conserved domains have been detected |

FIG. 17C

| | | | | | | |
|---|---|---|---|---|---|---|
| 7 | 5443 | MTIDDLLVKFKSLEKIDH NSEDEYLKQLLKMSYE RIKNQCGVFELENLIGQ ELILRARYAYQDLLEHF NDNYRPEIIDFSLSLME VSEDEESV (SEQ ID NO: 623) | 94 | hypothetical protein SA1772 [Staphylococcus phage phiN315] | NP_835558.1 | 2e-46 (94/94) | | No putative conserved domains have been detected |
| 8 | 5711 | MKKVFKKPRITTKRLNT RVHFYKYTENNGPEAG EKEEKLLYSCWASIDG VWLRELEQAISNGTQN DIKLYIRDPQGDYLPSE EHYLEIESRYFKMRLNI KQVSPDLDNKDFIMIRG GYSS (SEQ ID NO: 624) | 120 | hypothetical protein SA1771 [Staphylococcus phage phiN315] | NP_835559.1 | 2e-65 (120/120) | | No putative conserved domains have been detected |
| | | | | phage head-tail adaptor, putative [Staphylococcus aureus subsp. aureus JH9] | YP_001247377.1 | 2e-65 (120/120) | head-tail adapter | |
| 9 | 6070 | MSVKVTGDKALERELE KHFGIKEMVKVQDKALI AGAKVIVEEIKKQLKPS EDSGALISEIGRTEPEW IKGKRTVTIRWRGPFER FRIVHLIENGHVEKKSG KFVKPKAMGGINRAIRQ GQNKYFETLKRELKNC D (SEQ ID NO: 625) | 135 | 77ORF029 [Staphylococcus phage 77] | NP_958610.1 | 4e-69 (132/134) | | No putative conserved domains have been detected |
| 10 | 6470 | VIDILYKVHEVISQDRIIR EHVNINNIKFNKYPNVK DTDVPFMDIDDPIPT TYTDGIDECAYSYIVQID VFVKYNDEYNARIIRNKI SNRIQKLLWSELKMGN VSNGKPEYIEEFKTYRS SRVYEGIFYKEEIKWQ (SEQ ID NO: 626) | 138 | hypothetical protein SA1769 [Staphylococcus phage phiN315] | NP_835561.1 | 2e-70 (133/134) | | No putative conserved domains have been detected |

FIG. 17D

| | | | | | | |
|---|---|---|---|---|---|---|
| 11a | 6877 | MAIKHASAPKAYFNITG LGFAKLTKEGAELKYSD ITKTRGLQKIVLNWWRT KNKLMLMVVQSNQGT QTEKVKFRYKCMLSLK RFAKLFLMKIMMKMAF TKRNKVNKTIT (SEQ ID NO: 627) | phi13 family phage major tail protein [Staphylococcus aureus] | YP_00124737 4.1 | 6e-18 (44/44) | No putative conserved domains have been detected |
| | | 109 | hypothetical protein SA1768 [Staphylococcus phage phiN315] | NP_835562.1 | 6e-17 (42/44) | major tail protein |
| 11b | 7104 | MHAFPKEIRKIVFNEDY DEDGVYEEKQGKQNN YVAVWFRQERRDGTF RTVLLPKVMFTNPKIDG ETAEKDWDFSSEEVEG EALPPLYDNKKSVRKYI FDSANMTNHDGDGEK GEEAFLKKILGHEEYTGN VTEGNEETL (SEQ ID NO: 628) | hypothetical protein SA1768 [Staphylococcus phage phiN315] | NP_835562.1 | 7e-76 (138/138) | No putative conserved domains have been detected |
| 12 | 7646 | 7786 LKYTTDQTNIVSINSDG QVTAEAQGIATVKATV GNMSDTITINVEA (SEQ ID NO: 629) | hypothetical protein NM3_gp49 [Staphylococcus aureus phage phiNM3] | YP_908838.1 | 1e-16 (45/46) | No putative conserved domains have been detected |
| 13 | 7836 | 8186 MAKLKRNIIQLVEDPKA NEIKLQTYLTPHFISFEI VYEAMDLIDDIEDENST MKPREIADRLMDMVVKI YDNQFTVKDLKERMHA PDGMNALREQVIFITQG QQTEETRNFIQNMIK (SEQ ID NO: 630) | hypothetical protein SA1767 [Staphylococcus phage phiN315] | NP_835563.1 | 2e-61 (116/116) | No putative conserved domains have been detected |
| 14 | 8213 | 8374 MLKNMDTLMMDLIENG KDANEVLKMPFHYVLSI YQNKNNDISEEKAEALI DAF (SEQ ID NO: 631) | 77ORF100 [Staphylococcus phage 77] | NP_958614.1 | 3e-22 (53/53) | No putative conserved domains have been detected |

FIG. 17E

| | | | | | | | | |
|---|---|---|---|---|---|---|---|---|
| 15 | 8431 | 12975 | MGERIKGLSIGLDLDAA NLNRSFAEIKRNFKTLN SDLKLTGNNFKYTEKST HSYKQRIKELDGTITGY KKNVDDLAKQYGKVSQ EQGENSAEAQKLRQEY NKQANEELNFLEKELEKT TTEFEEFKKAQVEAQR MAESGWGKTSKVFES MGPKLTKMGDGLKSIG KGLMIGVTAPVLGIAAA SGKAFAEVDKGLDTVT QATGATGGELKKLQNS FKDVYGNFPADAETVG GVLGEVNTRLGFTGKE LESATESFLKFSHITGS EGVQAVQLITRAMGDA GIEADEYQSVLDMVAK AAQASGISVDTLADSIT KYGAFMRAMGFEMKE SIALFSQWEKSGVNTEI AFSGLKKAISNWGKAG KNPREEFKKTLAEIEKT PDIASATSLAIEAFGAKA GPDLADAIKGGRFSYQ EFLKTIEDSQGTVNQTF KDSESGSSERFKVAMNK LKLVGADVWTSIESAFA PVMEELIKKLSIAVDWF SNLSDGSKRSIVIFGGIA AAIGPVVFGLGAFISTIG NAVTVLAPLLAGIAKAD GLISFLSTKVPILGTVFT ALTGPIGIVLGVLAGLAV AFTIAYKKSETFRNFVN GAINSVKQTFSNFIQFIQ PFIDSVKNVFKQAVSAI VDFAKDIWSQINGFFNE NGISIVQALQNICNFIKAI FEFILNFVIKPIMFAIWQ VMQFIWPAVKALIVSTW ENIKGVQGALNILGFIK FFSSLPTGNWRGVWD | 1514 | TPg01 family phage tail tape measure protein [Staphylococcus aureus subsp. aureus JH9] | YP_00124737 0.1 | 0.0 (1327/1526) | tail tape measure protein | COG5412, phage-related protein [function unknown] | COG5412 | 9e-153 |
| | | | | | phage tail tape measure protein [Staphylococcus aureus phage phiNM3] | YP_908841.1 | 0.0 (1325/1526) | | PhageMin_T ail, phage-related minor tail protein | pfam10145 | 7e-25 |
| | | | | | | | | | Peptidase family M23 | pfam01551 | 2e-18 |
| | | | | | | | | | Lytic transglycosyl ase (LT) and goose egg white lysozyme (GEWL) domain | cd00254 | 3e-07 |

FIG. 17F

```
GIVMILKGTVQLIWNLIQ
LWFVGKILGVVRYFGG
LLKGLISGIWGVIKGIFT
KSLSAIWNATKSIFGFL
YNSVKSIFTNMKNWLS
STWINNIKSNTVGKAHS
LFTGVRSKFTSLWNAT
KDIFTKLRNWMISNIWN
SIKDNTVGIAGRLWDRV
RNIFGSMRDGLKSIISKI
KDHIGGMVDAVKRGLN
KLIEGLNWWGGKLGMD

| 16 | 13144 | RKASKNKRPSQLSSVN GFDDPSLLLKMIEQQQ QQIALLLKIAQSNDVIAD KDYQPIIDEYAFDKKVN ASIEKRERQESTKVKFR KGGIAIQ (SEQ ID NO: 632) | | | | |
|---|---|---|---|---|---|---|
| | | phi77 ORF004-like protein, putative phage tail component [Staphylococcus aureus subsp. aureus USA300] | YP_494580.1 | 0.0 (389/390) | | |
| | 14328 | VVRNDYLSHNGFKTHD DVLNELVKFFNYEEQV KLQFKSKDWYWNAYF EGPIKLHKEFAIPVKFTI KVVLTDPYKYSVTGYK NTAISIDQVSVVNSGTA DTPLIVEARAIKPSSYF MITKNDEDYFMVGDDE VTKEVKDYMPPVYHSE FRDFKGWTKMITEDIPS NDLGGKVGGDFVISNL GEGYKATNFPDAKGW VGAGTKRGLPKAMTDF QITYKCIVEQKGKGAGR TAQHIYDSDGKLLASIG YENKYHDRKIGHIVVTL YNQKGDPKKIYDYQNK PIMYNLDRIVVYMRLRR VGNKFSIKTWKFDHIKD PDRRKPIDMDEKEWID GGKFYQRPASIIAYSAK YNGYKWMEMNGLGSF NTEILPKPKGARDVIIQK GDLVKIDMQAKSSCHQ (SEQ ID NO: 633) 394 | hypothetical protein SA1765 [Staphylococcus phage phiN315] | NP_835565.1 | 0.0 (388/390) | tail component | No putative conserved domains have been detected |

FIG. 17H

| | | | | | | |
|---|---|---|---|---|---|---|
| 17a | 14474 | VIHVLDFNDKIIDFLSTD DPSLVRAIHKRNVNDN SEMLELLISSERAEKFR ERHRVIIRDSNKQWRE FNNWVQDTMDGYTEIE CIASYLADITTAKPYAP GKFEKKTTISEALKDVLS DTGWEVSEQTEYDGL RTTSWTSYQTRYEVLK QLCTTYKMVLDFYIELS SNTVKGRYVVLKKKNS LFKGKEIEYGKDLVGLT RKIDMSEIKTALIAVGPE NDKGKRLELVVTDDEA QSQFNLPTRYIWGIYEP QSDDQNMNETRLRSLA KTELNKRKSAVMSYEIT STDLEVTYPHEIISIGDT VRVKHRDFNPPLYVEA EWAEEYNIISENSTYTF GQPKEFKESELREEFN KRLNIIHTKVKR (SEQ ID NO: 634) | 363 | phi PVL ORF 20 and 21-like protein [Staphylococcus aureus subsp. aureus Mu50] | NP_372477.1 | 0,0 (357/361) | | No putative conserved domains have been detected |
| | 15565 | | | phage minor structural protein [Staphylococcus aureus phage phiNM3] | YP_908843.1 | 0,0 (354/361) | minor structural protein | |
| 17b | 15675 | MLWYDTSNPDVAVLRR YWNGRWIEATPNDVEK LGGITREKALFSELNNIF INLSIQHASLLSEATELL NSEYLVDNDLKEDLQA SLDAVIDVYNQIKNNLE SMTPETATIGRLVDTQA LFLEYRKKLQDVYTDVE DVKMAISDRFKLLQSQ YTDEKYKEALEIIATKFG LTVNEDLQLVGEPNVV KSAIEAARESTKEQLRD YVKTSDYKTDKDGIVER LDTAEAERTTLKGEIKD KVTLNEYRNGLEEQKQ YTDDQLSDLSNNPEIKA SIEQANQEAQEALKSYI | 861 | 77ORF002 [Staphylococcus phage 77] | NP_958817.1 | 0,0 (859/861) | TolA protein and chromosome segregation protein | pfam065 19 and PRK011 56 | 9e-05 and 6e-04 |
| | 18260 | | | phage minor structural protein [Staphylococcus aureus phage phiNM3] | YP_908843.1 | 0,0 (855/860) | | | |

FIG. 17I

| | | | | | | |
|---|---|---|---|---|---|---|
| 18 | 18250 | | | | | |
| | 18402 | MQDNKCGLQANPEYTI HYLSQEIMRLTQENAM LKAYIQENKENQQCAE EE (SEQ ID NO: 636) DAQDDLKEKESQAYAD GKISEEEQRAIQDAQAK LEEAKQNAELKARNAE KKANAYTDNKVKESTD AQRKTLTRYGSQIIQNG KEIKLRTTKEEFNATNR TLSNILNEIVQNVTDGT TIRYDDNGVAQALNVG PRGIRLNADKIDINGNR EINLLIQNMRDKVDKTDI VNSLNLSREGLDINVNR IGIKGGDNNRYVQIQND SIELGGIVQRTWRGKR STDDIFTRLKDGHLRFR NNTAGGSLYMSHFGIS TYIDGEGEDGGSSGTI QWWDKTYSDSGMNGI TINSYGGVVALTSDNN RVVLESYASSNIK5KQA PVYLYPNTDKVPGLNR FAFTLSNADNAYSSDG YIMFGSDENYDYGAGI RFSKERNKGLVQIVNG RYATGGDTTIEAGYGK FNMLKRRDGNRYIHQS TDLLSVGSDDAGDR/AS NSIYRRTYSAAANLHIT SAGTIGRSTSARKYKLS IENQYNDRDEQLEHSK AILNLPIRTWFDKAESEI LARELREDRKLSEDTY KLDRYVGLIAEEVENLG LKEFVTYDDKGIEIGIA YDRLWIHLIPVIKEQQL RIKKLEESKNAG (SEQ ID NO: 635) | 50 | hypothetical protein phlPV83p55 [Staphylococcus prophage phlPV83] | NP_061844.1 | 2e-20 (50/50) | No putative conserved domains have been detected |

FIG. 17J

| # | | Sequence | | Description | Accession | E-value | Function | Domain |
|---|---|---|---|---|---|---|---|---|
| 19 | 18449 | MAKEIINTERFILVQID KEGTERVVYQDFTGSF TTSEMVNHAQDFKSEE NAKKIAETLNLLYQLTN KKQRVK (SEQ ID NO: 637) | 73 | hypothetical protein PVL_21 [Staphylococcus phage PVL] | NP_058460.1 | 4e-35 (73/73) | | No putative conserved domains have been detected |
| 20 | 18793 | LGWFKKHEHEWRIRRL EENDKTMLSTLNEIKLG QKTQEQVNIKLDKTLDA IQKEREIDEKNKKENDK NIRDMKMWVLGLVGTI FGSLIIALLRMLMGI (SEQ ID NO: 638) | 98 | phi PVL ORF 17 homologue [Staphylococcus prophage phiPV83] | NP_061646.1 | 9e-48 (97/98) | | No putative conserved domains have been detected |
| 21 | 19281 | MVALLKSLERRRLMITI STMLQFGLFLIALIGLVI KLIELSNKK (SEQ ID NO: 639) | 44 | hypothetical protein SAR2042 [Staphylococcus aureus subsp. aureus MRSA252] | YP_041413.1 | 8e-15 (44/44) | | No putative conserved domains have been detected |
| | 19415 | | | ORF087 [Staphylococcus phage 42E] | YP_Z398821.1 | 4e-14 (43/44) | | |
| 22 | 19627 | MINWKIRMKQKSFWVA ILSAIFLFAQNIAKAIGYD IQVYTEQLTDGLNAILG FLVLTGVIQDPTTKGIG DSHQALEYEEPRRKY (SEQ ID NO: 640) | 84 | holin-like protein [Staphylococcus aureus subsp. aureus Mu50] | NP_372470.1 | 2e-42 (84/84) | holin | Phage_holin_1, bacteriophage holin | pfam045 31 | 1e-32 |
| | 19881 | | | holin [Staphylococcus prophage phiPV83] | NP_061647.1 | 8e-42 (83/84) | | |
| 23 | 19893 | MKTYSEARARLRWYQ GRYIDFDGIWYGYQCA DLAVDYIYWLLEIRMW GNAKDAINNDFKNIMAT VYENTPSFVPQIGDVAV FTKGIYKQYGHIGLVFN GGNTNQFLILEQNYDG NANTPAKLRWDNYYG CTHFIRPKYKSEGLMIN KITNIKVKPPAQKAVGKS ASKITVGSKAPYNLKW | 251 | amidase [Staphylococcus phage phi13] | NP_803402.1 | 2e-146 (251/251) | CHAP endolysin | CHAP domain |
| | 20648 | | | | | | | pfam052 57 | 1e-17 |

FIG. 17K

| | | | | | | | |
|---|---|---|---|---|---|---|---|
| 24 | 20838 | SKGAYFNAKIDGLGATS ATRYGDNRTNYRFDVG QAVYAPGTLIYVFEIIDG WCRIYWNNHNEMWH ERLIVKEVF (SEQ ID NO: 641) | | | | | |
| | | MLKRGLLFLTVLLLFS FSSITNEVSASSSFDKG KYKKGDDASYFEPTGP YLMVNYTGVDGKGNEL LSPHYVEFPIKPGTTLT KEKIEYYVEWALDATAY KEFRVVELDPSAKIEVT YYDKNKKKEETKSFPIT EKGFVVPDLSEHIKNPG FNLITKVVIEKK (SEQ ID NO: 642) | 211330 | 163 | staphylokinase precursor [Staphylococcus aureus phage phiNM3] | YP_908850.1 | 9e-88 (162/163) | staphylokinase | Staphylokina se/Streptoki nase family | pfam02821 | 3e-18 |
| 25 | 22020 | VPAGYTLDKNNVPYKK ETGYYTVANVKGNNVR DGYSTNSRITGVLPNN ATIKYDGAYCINGYRWI TYIANNGQRCYIATGEV DKAGNRISSFGNFSAL (SEQ ID NO: 643) | 22316 | 98 | truncated amidase [Staphylococcus aureus subsp. aureus Mu3] | YP_001442618.1 | 5e-49 (97/98) | cell wall hydrolase remnant | Bacterial SH3 domain | pfam08460 | 7e-05 |
| | | | | | peptidoglycan hydrolase [Staphylococcus phage phi 12] | NP_803355.1 | 4e-47 (93/98) | | | | |
| 26 | 22826 | MKIRKSILAGTLAIVLAS PLVTNLDKNEAQASTSL PTSNEYQNEKLANELK SLLDELNVNELATGSLN TYYKRTIKISGQKAMYA LKSKDFKKMSEAKYQL QKIYNEIDEALKSKY (SEQ ID NO: 644) | 23176 | 116 | hypothetical protein SAV1942 [Staphylococcus aureus subsp. aureus Mu50] | NP_372466.1 | 1e58 (116/116) | Staphylococcal Complement Inhibitor | No putative conserved domains have been detected | | |
| | | | | | Staphylococcal complement inhibitor [Staphylococcus aureus phage phiNM3] | YP_908853.1 | 1e-58 (116/116) | | | | |

FIG. 17L

| | | | | | | |
|---|---|---|---|---|---|---|
| 27 | 25470 | MKTRCYDGKKWQYEF KYEGKRYRKKGFRTKR EANSAQLDKLNELRSG FNIDNYITLEEYFENWIK TYKQPVVKENTYRHYR NALQHIQKHKIGKMELS KINRQVYQKFINDYSKE HAKETIRKTNGAIRSAL DDALYDGLIFKNPAYKV NYKAGKPTKSEQEKFIS VTEYEILKDHVRKKRTR SSLALFIMCTGCRVSG ARNIKIEHINQVKNTIFID ERKTDTSPRYISIAKSD MKHIMDVISTFAISYDG YIFKEAGSIINLHAINNAL KSACRVNNIPIITSHALR HTHCSYLLAKGVSIHYI SKRLGHKNAITTSVYS HLLEEKFNEEDKKQLKF RKYVI (SEQ ID NO: 645) | 346 | phage integrase family protein [Staphylococcus aureus subsp.aureus USA300_TCH1516] | ZP_02761075. 1 | 0,0 (338/341) | | |
| | | | | integrase [Staphylococcus aureus phage phiNM3] | YP_9087790.1 | 0,0 (335/341) | integrase | phiLC3 phage and phage-related integrases | cd01189 | 1e-34 |
| 28 | 25661 | LNGGESVSENKGEMM THNIEKRINKLKTSGNP KFKKLDSDIHYLLKRFE GEKNHKGFYPKFKQGE IVFVDFGINVNIKEFSNS HFAIVMNKNDSNTEDIV NVIPLSSKENKKYLKMN FDLKWEYYLRLFLNLIS AQNNSAILKEVFDKKYQ KNNTEFITKDYFSEFISD SLEIENKLNKIDRNINNI VSAIDKVKKLKGNSYAC INSFQPISKFRIRKVLPQ KIKNPVIDSSDIMLLINRI NNNILQIPDIR (SEQ ID NO: 646) | hypothetical protein SaurJH9_2059 [Staphylococcus aureus subsp. aureus JH9] | YP_00124741 8.1 | 1e-134 (244/245) | |
| | 26416 | | | 77ORF017 [Staphylococcus phage 77] | NP_958624.1 | 1e-129 (236/237) | No putative conserved domains have been detected |

FIG. 17M

| | | | | | | |
|---|---|---|---|---|---|---|
| 29 | 26634 | MKITNCKIKKETIVYEVL TSGNQPFTYELPKDLS SHNARKYLEFISQKIDG DKLTKEDSL (SEQ ID NO: 647) | 60 | hypothetical protein phi12p03 [Staphylococcus phage phi 12] | NP_803309.1 | 3e-27 (60/60) | No putative conserved domains have been detected |
| 30 | 26890 | MSTYKEIEHLHINTGGK ELTQEQIEEAKAFIDSQ EFKDMIREAKESHQRV MESKITDRTKL (SEQ ID NO: 648) | 61 | hypothetical protein SaurJH9_2057 [Staphylococcus aureus subsp. aureus JH9] | YP_001247416.1 | 4e-27 (61/61) | No putative conserved domains have been detected |
| | 26705 | | | hypothetical protein phiPV83p04 [Staphylococcus prophage phiPV83] | NP_061594.1 | 1e-25 (58/61) | |
| 31 | 27033 | MDFKEVDINIEEWEMV EIPFYTEEELTYRLNNG LPITKSELEEEQESKK (SEQ ID NO: 649) | 48 | hypothetical protein SaurJH9_2056 [Staphylococcus aureus subsp. aureus JH9] | YP_001247415.1 | 9e-19 (48/48) | No putative conserved domains have been detected |
| | 26887 | | | hypothetical protein phiETA_05 [Staphylococcus phage phiETA] | NP_510899.1 | 1e-17 (46/48) | |
| 32 | 27107 | MKPRKQDEKILSDQYS YFEPIISDSCDIKFDENK RRMGSIFISHEEICFIRK EEDYIFKISLSEVIDYNT VVTIWKNQAFLTLNDN RKLTVYFYTNSPLTGFI SILKTYMQLSKNKETIIS NDCLPINDDEQTKVEIF DVVGLNYEGRRKELKK LIKKMKNNDDFFFLYSD LKGNELKEELLYEDKVY EISDYEVIPGVFLQKEP DNPYDENAIKVMISNEY SEFHVGYVPREYASRL VNHMDNIVSCNAYING GKYKTLDYLEEKIVTKE | 284 | HIRAN [Staphylococcus aureus subsp. aureus JH9] | YP_001247414.1 | 3e-162 (284/284) | HIRAN domain | DNA binidng protein, putative helicase |
| | 27961 | | | phage protein [Streptococcus phage 10750.3] | YP_602821.1 | 0.005 (45/151) | |
| | | | | SNF2 family helicase, putative [Aspergillus fumigatus A1163] | EDP51408.1 | 0.0004 (22/46) | pfam08797 | 6e-11 |

FIG. 17N

FIG. 17O

| | | | | | | | |
|---|---|---|---|---|---|---|---|
| | | SDYGLRVHLEYKV (SEQ ID NO: 650) | | | | | |
| 33 | 28689 | MNSFKDRLKQIMSERKI SQSELSRRTGIGRNSIS DYLNGKYEAKQDKVFE LAKALNVNEAWLMGFD ISKNRKIENNDITSIY3K LTPPRQSNVLKYATNQ LEEQNDSDNLVDFNS YIQEKSEVDIYGCASAG IGERLYNEPISKEFVRG YVPAHDIALKVNGDSM EPLFKNGQIIFIEK3H TIK DGQIGVFIINGDAYVKK VYVEDNRLTLVSLNKKY KDLYFDNESVRLVGK VIL (SEQ ID NO: 651) | 238 | putative phage repressor [Staphylococcus aureus subsp. aureus JH9] | YP_00124741 3.1 | 8e-135 (238/238) | | Peptidase S24 LexA-like proteins | cd06529 | 1e-16 |
| | 27973 | | | similar to phage phi PVL repressor [Staphylococcus phage phiETA] | NP_510900.1 | 1e-108 (189/238) | cl-like repressor | Helix-turn-helix XRE-family like proteins | cd00093 | 9e-10 |
| 34 | 28853 | MIYNFDYSLLYERMAEY RYSQSSLANAIPISRTSI NHKLQGKNLFTQWEIK RICELLEIPPTKVGRYFF EQNVQKPVQMS (SEQ ID NO: 652) | 80 | hypothetical protein SaurJH9_2053 [Staphylococcus aureus subsp. aureus JH9] | YP_00124741 52.1 | 1e-40 (80/80) | | | |
| | 29095 | | | putative cro-like repressor [Staphylococcus phage phiPVL108] | YP_918897.1 | 3e-39 (78/80) | cro-like repressor | Helix-turn-helix XRE-family like proteins | cd00093 | 0.006 |
| 35a | 29108 | MEQITLTKEELKEIIAKE VREAINGKKPISSGSNF QQSKNQP (SEQ ID NO: 653) | 42 | | | | | | | |
| | 29236 | | | 77ORF023 [Staphylococcus phage 77] | NP_958630.1 | 2e-10 (34/39) | | No putative conserved domains have been detected | |
| 35b | 29178 | MARNQSVQVLIFNKVRI SHNDFDEINKKFAYTER LRGADNLGLGHPLSLK KYQHGIGCYENYKAYA SEIHDHIRKLTLSAFGVT LNSDLKESEYDEASRM YDMLKNFYLYRYQKRIE TLSIEDFE (SEQ ID NO: | 125 | | | | | | | |
| | 29555 | | | 77ORF023 [Staphylococcus phage 77] | NP_958630.1 | 1e-28 (64/115) | | No putative conserved domains have been detected | |

| | | | | | | | |
|---|---|---|---|---|---|---|---|
| 36 | 29570 | | 654) | | | | |
| | | 29710 | MLQKFRIAKEKNKLKLK LLKHASYCLERNNNPE LLRAVAELLKKVS (SEQ ID NO: 655) | 46 | 77ORF117 [Staphylococcus phage 77] | NP_958631.1 | 1e-16 (46/46) | | No putative conserved domains have been detected |
| 37 | 29912 | 29703 | MKLLVTLKDGSKKHVS DLKKIVFPGYEGIETVT KEEIETFFLDPTKTYVF VGSQTLSVEAGQILTVE FS (SEQ ID NO: 656) | 69 | 77ORF066 [Staphylococcus phage 77] | NP_958632.1 | 9e-31 (69/69) | | No putative conserved domains have been detected |
| 38 | 29969 | 30718 | MQALQTKSNIGEMFNI QEKENGEIAISARELYK ALEVKKRFSAWAEINLK HFKENRDFTSVLTSTVV NNGAVRQLEDYALTLD VAKHVAMMSGTEKGF DFREYFIQVEKAWNSP EMIMQRALKIANNTINQ LETKIERDKPKIVFADAV ATTKTSILVGELAKIIKQ NGVNIGQRRLFEWLRQ NGFLIKRKGVDYNMPT QYSMERELFEIKETSIT HSDGHTSISKTPKVTGK GQQYFVNKFLGEKQTS (SEQ ID NO: 657) | 249 | ORF017 [Staphylococcus phage 71] | YP_240419.1 | 1e-143 (247/249) | antirepressor | Phage antirepressor protein KilAC domain / pfam03374 / 6e-36 |
| 39a | 30731 | 30991 | MEQITLTKEECVEQCIN KDLKLLDYRVQQILEGV LSESTTYGDARNKLETL KIIAESHFKTEHASVIYK LALKKLDKKINATPIKE (SEQ ID NO: 658) | 86 | transcriptional regulator [Staphylococcus phage phiPVL108] | YP_918899.1 | 3e-32 (86/86) | transcriptional regulator | No putative conserved domains have been detected |

FIG. 17P

| | | | | | | | |
|---|---|---|---|---|---|---|---|
| 39b | 31011 | MFKILNDIKTSLKNHPW GWKEHLPYLLMLTLSL VALIFGVLSAIL (SEQ ID NO: 659) | | | | No putative conserved domains have been detected | |
| | 31148 | | 45 | transcriptional regulator [Staphylococcus phage phiPVL108] | YP_918890.1 | 2e-17 (44/45) | |
| 40 | 31215 | MIEMPHVLNVTVPIPET HVLITKDEYEELIAYSLD PVWNMSDLKKKLKIAS DETIKDRLLFHPRFEKE LRAQGIVHYPDENFNR WRFNARKMNKFVDEH FNEIYKERIK (SEQ ID NO: 660) | 109 | ORF045 [Staphylococcus phage 69] | YP_239609.1 | 7e-55 (104/106) | Domain of unknown function (DUF771) | pfam05595 | 1e-32 |
| 41 | 31541 | MSKTYKSYLLAVLCFTV LAIVLMPFLYFTTAWSIA GFASIATFIFVKEYFYEE (SEQ ID NO: 661) | 53 | similar to phage phi PVL ORF38 [Staphylococcus phage phiETA] | NP_510908.1 | 2e-21 (53/53) | Protein of unknown function (DUF1270) | pfam06900 | 2e-10 |
| 42 | 31797 | MYYKIGDVCQKVINVD GFDFKLAVKKQDYSILV NVLDLEDRFIDSINITOE NDLYTALDILNQSIYEWI EENTOERDRLINLVMR W (SEQ ID NO: 662) | 86 | phi PVL of 39-like protein [Staphylococcus phage phi13] | NP_803365.1 | 8e-41 (85/86) | Protein of unknown function (DUF1108) | pfam06531 | 1e-33 |
| 43 | 32066 | MVGISMRDTERNILNIF KTLFDEYTLSNQRALLE IERNHHGYLSINFLHYH DSYKTNNKLVQIHEINP DSHERIKNLIIEVLRGHR KIKKGA (SEQ ID NO: 663) | 92 | hypothetical protein NM3_gp18 [Staphylococcus aureus phage phiNM3] | YP_908807.1 | 3e-48 (92/92) | No putative conserved domains have been detected | |
| | 32329 | | | | | | |

FIG. 17Q

| 44 | 32332 | 34281 | MEIKINKLTISNFAGIKE ESFNFNGKDAKIYGNN ATGKTTFATALQWLLF DKGLDGSTKSFNPVPL NEKNEENYELIPTVFAE FEIDGKITTFKKESHPK YTINQKTNRKEYSRSRT KKQYINDESIKVKDYKA RIDELIDEDVFKLITNPQ AFNLLDWKKRRSLLFEI AKPINDEDVIKTNDDFK ELNNILGDHEIETKKKL TDKIKQJNKDIKDIPIFIIN QTQQNKQDVPEFDND RYAIIKQEIEQLENERIDI QNGKEEINLRNQLADK QSELKRIEDNNSASNE NKIHALTNELHVENGTV ANLKTRLKQNKQQITHE ENRRNQLLENHKGLKS DLEKAKNQKFEYLDDN VCSCCGQQLPAEQVSE VREKALQKFNANKSKE LETIQTSINHIISEGKKIK PIIEKLEDDNNNLQIKIN EAEERSARIQNKINKLK TTHVDVTQTDEYKAVM LEINEINQKRSNIRKTIQ DKVSGIDDKSELTQEK SEIEVSISIEKSNKHLDD VISELRNEEDRLLDEKE KYSHDLYILKEFTTTKV KMLTENINNEFDIAEFK LFNTLVNGELEETCSTT VNGVEYDSGLNNASRI NVGLDIINTLSKHFKVTA PIFIDNAESVTELIKTES QQIQLIVNEQDKKLRME TI (SEQ ID NO: 664) | 849 | hypothetical protein SA1795 [Staphylococcus phage phiN315] | NP_855534.1 | 0,0 (639/647) | | SMC_N, RecF/RecN/ SMC N terminal domain | pfam0240 63 | 5e-06 |

FIG. 17R

| | | | | | | | |
|---|---|---|---|---|---|---|---|
| 45 | 34203 | MTENNKLQTIEQQLVQ EKNVSDNVLNKVRVLE SQGNLELPNDYSPSNA MKQAWLQISQDNKLMS CNDTSKANALLDMVTQ GLNPAKNQCYFIPYGN KMQLQRSYHGNVMML KRDAGAQDVVAQVIYK GDTFKQEMGETGRIKAI KHEQDFFNIDKENIIGA YCTIVFNDGRDNYIEVM TIEQIKQAWMQSSMIKD EKALQNSKTHNNFKEE MAKKTVINRAAKRYINT STDSNLFKYAQESEQR QRKEVLDAEVEENANQ EQLDFEQPVLEEAQYT ELENDKPIDVSDFEEIK EPATEKESEEEPF (SEQ ID NO: 665) | 306 | hypothetical protein PVL_43 [Staphylococcus phage PVL] | NP_058482.1 | 1e-179 (306/306) | recombinase | RecT family | pfam038 37 | 8e-45 |
| 46 | 35548 | VAFLLQSTLGYKVLYVT DTKYLYKFNGITHMML EVNYIYEQMQENIKNG SVHSTLANRIMESHFSL EHAIGMLKANDLTRLEE IHIJHLSSQNSNAKYIKS EIQKVTGAPVYFGGL (SEQ ID NO: 666) | 117 | phiPVL ORF044-like protein [Staphylococcus aureus subsp. aureus USA300] | YP_494610.1 | 4e-62 (117/117) | partial metallo-beta-lactamase domain | PhnP, Metal-dependent hydrolases of the beta-lactamase superfamily I | COG123 5 | 1e-05 |
| | 35901 | | | hypothetical protein NM3_gp21 [Staphylococcus aureus phage phiNM3] | YP_908810.1 | 3e-61 (116/117) | | | |
| 47 | 35902 | MLNRTILVGRLTRDPEL RTTQSGVNYASFTLAV NRTFTNAQGEREADFI NIIVFKKQAENVNKYLS KGSLAGVDGRLGTRNY ENKEGQRVYVTEVIAD SIQFLEPKNSNDTQGDL YQQQVQQTRGQSQYS NNKPVKDNPFANANGP IELNDDLPF (SEQ ID NO: 667) | 156 | single-strand DNA-binding protein [Staphylococcus aureus subsp. aureus Mu50] | NP_372507.1 | 3e-85 (156/156) | ssDNA-binding protein | Single-strand DNA-binding protein | PRK067 51 | 5e-41 |
| | 36372 | | | single-strand DNA-binding protein [Staphylococcus phage phiN315] | NP_835537.1 | 8e-84 (153/156) | | | |

FIG. 17S

| | | | | | | | |
|---|---|---|---|---|---|---|---|
| 48 | 36402 | MTGWSIDRSIQNHWLF KEKRTFSKFEAWYLLM EANHSEAKVPIGNQIVT VERGQRLTSILTLSDLF NWSRFKVKTFLDLLES DGMLEVKTTSKYTLTIV NYDFYQSEQGRNQHQ NDIKFTSKQHQSNINPT SKQHQTNTNNNDNKD NNEKNVNNEKKKVTAF DFFQDNGFGFITPYNLD DLNYYLDSFEND3DEIV TASLKIAKDRNKVTWG YAKSILNTWLNANLKSI EQVRAFEKQQLESHKQ NYKPPVKQSKEKTPKW LTDSTRETKTPEVDENL EKDREAFIKRLNSKWE (SEQ ID NO: 668) | 297 | hypothetical protein PVL_46 [Staphylococcus phage PVL] | NP_058485.1 | 8e-171 (295/297) | primosome component | DnaD, putative primosome component and related proteins | COG3935 | 1e-41 |
| 49 | 37302 | MDAFDKYYLFDHDGNK MFSVTPHFKDGRHLW GLKHTKFNGRRWYLDD YELKTLIDNEQMELGH QTSLFEYI (SEQ ID NO: 669) | 72 | hypothetical protein PVL_47 [Staphylococcus phage PVL] | NP_058486.1 | 3e-35 (72/72) | | No putative conserved domains have been detected |
| 50 | 37623 | MPTKYTEHKKYLQNQM PKLNLENALKIELEFYT PPKSWSKKKKTQAIGQ LKVTKPDIDNLMKTVLD ACNNYLNKDDNQIAEIT SSKRYGIEPKIIIRIEEI (SEQ ID NO: 670) | 102 | putative endodeoxyribonuclease RusA [Staphylococcus aureus phage phiNM3] | YP_908814.1 | 5e-53 (102/102) | endodeoxy-ribonuclease | Endodeoxy-ribonuclease RusA | pfam05866 | 2e-15 |
| 51 | 37944 | MARKARIVTINDKPYRF TKSEMELIESHGITAGIM VSKRVKDGWELHEAM DAPEGTRLSEYREKKTI ERLEQARLERKLERKR | 122 | phiPVL ORF050-like protein [Staphylococcus aureus subsp. aureus USA300] | YP_494605.1 | 4e-65 (122/122) | | PVL ORF-50-like family | pfam07768 | 9e-30 |

FIG. 17T

| | | | | | | | | |
|---|---|---|---|---|---|---|---|---|
| 52 | 38316 | KKEAELRRKPHLFNV PQKHPRGRYACYLME NDIFVKVKK (SEQ ID NO: 671) | | hypothetical protein PVL_49 [Staphylococcus phage PVL] | NP_058488.1 | 1e-61 (117/122) | | | |
| 53 | 38701 | 38558 | MTDNARKEYLNQFFGS KRYLYQDNERVAHIHV ANGNYYFHGHIVPGWQ GVIKKTFDTAEELEIYIK QHGLEYEKQKQLTLF (SEQ ID NO: 672) | 80 | ORF062 [Staphylococcus phage 69] | YP_239629.1 | 1e-38 (76/80) | | Phage conserved open reading frame 51 | pfam08194 | 2e-32 |
| 53 | 38802 | MQDALKEDIGLDEAVGI MTGQVVYKYEEAQENE (SEQ ID NO: 673) | 33 | hypothetical protein phi2958PVL_gp24 [Staphylococcus phage phi2958PVL] | YP_002267994.1 | 2e-09 (32/33) | | Protein of unknown function (DUF1024) | pfam06260 | 2e-04 |
| 54 | 38795 | 39331 | MNNTLTIDQLQELLQIQ KEFDDRIPTLNLRDSKI AYVVEFFEVVFNTLETF KNWKKKPGKPLDVQLD ELADMLAFGLSIANQVG VSSEEIKEAIESSFKDTE FHKMFNFKDKEFAQDA VVSTPQIIFKEFYPDQQ AIVIVIDIAYNLYSIDQLID AYKKKMKRNHERQDG TADAGKGYV (SEQ ID NO: 674) | 178 | hypothetical protein SAPPV1_gp31 [Staphylococcus phage phiNM] | YP_873980.1 | 9e-99 (177/178) | dUTPase | dUTPase_2 | pfam08761 | 1e-12 |
| 55 | 39368 | 39613 | VSDMLEIFLIGFGVYLFY RIAIIFLKSKKTIHTNYE MLMLATIFMISTFAYKH QKTHILIAFELVMFFMSKL KQVQGSYEE (SEQ ID NO: 675) | 81 | ORF063 [Staphylococcus phage 52A] | YP_240665.1 | 1e-37 (80/81) | | | No putative conserved domains have been detected | |
| 56 | 39610 | 39816 | MTQYLVTTFKDSTGRK HTHTKAKSNQRFTVVE AESKEEAKEYEKQVK RDAVIKVGQLFENIREC GK (SEQ ID NO: 676) | 68 | similar to phage phi PVL ORF55 [Staphylococcus phage phiETA] | NP_910829.1 | 1e-31 (88/88) | | Protein of unknown function (DUF1381) | pfam07129 | 4e-08 |

FIG. 17U

| | | | | | | | | |
|---|---|---|---|---|---|---|---|---|
| 57 | 39813 | 40199 | MIKKLKNMDGFDIFIVGI LSLFGITALLLVVALPIYT VASYQNKEVHQGTITD KYNKRQDKEDKFYIVLD DKQVIENSDLFFKGKFD SADIQARLKVGDKVKV KTIGYRIHFLNLYPVLYE VKKVDKK (SEQ ID NO: 677) | 128 | hypothetical protein phiETA_36 [Staphylococcus phage phiETA] | NP_510930.1 | 6e-66 (128/128) | | Protein of unknown function (DUF1523) | pfam075 09 | 2e-05 |
| 58 | 40196 | 40345 | MIKQILRLLFLLAMYELG KYVTEQLVYIMMTANDD VEAPSDYVFRAEVSE (SEQ ID NO: 678) | 49 | hypothetical protein SA8062 [Staphylococcus phage phiN315] | NP_835548.1 | 4e-20 (49/49) | transcriptional activator | Transcriptional activator RinB | pfam081 16 | 2e-15 |
| 59 | 40345 | 40645 | MWITMTIVFAILLLVCISI NSDRAREIQALRYMND YLLDEVVKTKGYNGLK EYRIELKRMNNDIKK (SEQ ID NO: 679) | 66 | phi PVL ORF 60 homologue [Staphylococcus prophage phiPV83] | NP_061623.1 | 3e-30 (66/66) | | Protein of unknown function (DUF1514) | pfam074 38 | 4e-22 |
| 60 | 40573 | 40989 | MIKIEKHDIKKLEEYIQHI DNYRRELKMREYELLE SHEPDNAGAGKSNLPG NPIERCAIKFSDNRYN TLRNIVNGVDRLIDESD EDTLELLRFRYWDCPIG CYEWEDIAHYFGTSKT SILRRRNALIDKLAKYIG YV (SEQ ID NO: 680) | 138 | hypothetical protein SA1780 [Staphylococcus phage phiN315] | NP_835550.1 | 2e-75 (138/138) | transcriptional regulator | No putative conserved domains have been detected | | |
| | | | | | putative regulator RinA [Staphylococcus phage CNPH82 | YP_950663.1 | 5e-58 (106/138) | | | | |
| 61 | 41221 | 41520 | MMTKDERIRFYKSKEW QTTRKRYLERDNYECQ QCKRDGKLTTYDKSKR KSLDVDHILSLEHHPEF AHDLNNLETLCIKCHNK KEKRFIKKENKWKDEK W (SEQ ID NO: 681) | 99 | hypothetical protein NM3_gp37 [Staphylococcus aureus phage phiNM3] | YP_908826.1 | 1e-50 (99/99) | endonuclease | McrA, restriction endonucleas e [defense mechanisms ] | COG140 3 | 7e-05 |

FIG. 17V

| Phage | Titer (pfu/ml) | Phage sensitivity (%) of STA strains (n=100) | | | | | Total of infected strains (%) |
|---|---|---|---|---|---|---|---|
| | | ++++ | +++ | ++ | + | - | |
| F87s/06 | 7,4x10$^{10}$ | 0 | 47 | 33 | 15 | 5 | 95 |
| | 7,4x10$^9$ | 0 | 17 | 20 | 18 | 45 | 55 |
| | 7,4x10$^7$ | 0 | 4 | 3 | 2 | 91 | 9 |
| | 7,4x10$^5$ | 0 | 1 | 1 | 2 | 96 | 4 |
| | 7,4x10$^3$ | 0 | 0 | 0 | 1 | 99 | 1 |

FIG. 18

| orf | Start position | Stop position | Aminoacidic sequence | Size (aa) | Homologous/similar proteins | | | Predicted function | Conserved Domains | | |
|---|---|---|---|---|---|---|---|---|---|---|---|
| | | | | | Organism/Name | Acc No | E value and Identity | | Name | Acc No | E value |
| 1 | 3 | 383 | PPSYNHFKAGDEMEIIVDENL VLKEKERLQVLYKDIPSNKLK VVDGLIIQAARLRVMLDYMW EDIKEKGDYDLFTQSEKAPPY ERERPVAKLFNARDAAYQKII KQLSDLLPEEKEDTETPSDD YL (SEQ ID NO: 682) | 126 | hypothetical protein SaurJH9_2024 [Staphylococcus aureus subsp. aureus JH9] | YP_001247384.1 | 2e-66 (126/126) | | No putative conserved domains have been detected | | |
| | | | | | hypothetical protein SA1778 [Staphylococcus phage phiN315] | NP_835552.1 | 4e-58 (114/114) | | | | |
| 2 | 456 | 2042 | LISLIIYKQHIYSRDDVYFDEQ KIEDCIKFIEKWYFPTLPFQRF IIANIFLIDKNTDEAFFTEFAIF MGRGGGKNGLISAISDFLSTP LHGVKEYHISIVANSEDQAKT SFDEIRTVLMDNKRNKTGKT PKAPYEVSKTEIINRATKSVIR YNTSNTKTKDGGREGCVFD EIHYFFGPEMVNVKRGGLGK KKNRRTFYISTDGFVREGYID AMKHKIASVLSGKVKNSRLFA FYCKLDDPKEVDDRQTWEK ANPMLHKPLSEYAKTLLSTE EEYNDLPFNRSNKPEFMTKR MNLPEVDLEKVIAPWKEILAT NREIPNLDNQMCIGGLDFANI RDFASVGLLFRKNDDYIWLG HSFVRQGFLDDVKLEPPIKE WEKMGLLTIVDDDVIEIEYIVD WFLKAREKYGLEKVIADNYR TDNVRRAAFEDAGIKLEVLRNP KAIHGLLAPRIDTMFAKHNVIY GDNPLMRVWFTNNVAVKIKPD GNKEYIKKDEVRRKTDGFMA FVHALYRADDIVDKDMSKAL | 528 | phage terminase [Staphylococcus aureus subsp. aureus JH9] | YP_001247383.1 | 0.0 (523/528) | terminase large subunit | Phage terminase-like protein, large subunit | COG4626 | 3e-132 |
| | | | | | 77ORF003 [Staphylococcus phage 77] | NP_958603.1 | 0.0 (517/521) | | | | |

FIG. 20A

| | | | | | | | |
|---|---|---|---|---|---|---|---|
| | | | DALMSIDF (SEQ ID NO: 683) | | | | |
| 3a | 2058 | 2516 | MSILEKIFKTRKDISYMLDLDM IEDLSQOAYYKRLAIDSCIEFV ARAVAQSHFKVLEGNRIQKN DVYYKLNIKPNTDLSSDSFW QQVIYKLIYDNEVLIVVSDSKE LLIADSFYREEYALYDDIFKDV TVKDYTYQRTFTMQEVILFKV QQQ (SEQ ID NO: 684) | 152 | HK97 family phage portal protein [Staphylococcus aureus subsp. aureus JH9] | YP_001247382.1 | 3e-79 (146/148) | | | 1e-13 |
| 3b | 2518 | 2904 | VTHFVESLFEDYGKIFGRMIG AQLKNYQIRGILKSASSAYDE KNIEKLQAFTNKLFNTFNKNQ LAIAPLIEGFDYEELSNGGKN SNMPFSELSELMRDAIKNVAL MIGIPPGLIYGETADLEKKHA CI& (SEQ ID NO: 685) | 128 | hypothetical protein SA1776 [Staphylococcus phage phiN315] | NP_835554.1 | 7e-79 (145/148) | portal protein | | 1e-09 |
| | | | | | hypothetical protein SA1776 [Staphylococcus phage phiN315] | NP_835554.1 | 3e-66 (123/123) | Phage portal protein | pfam04860 | |
| 3c | 2975 | 3223 | MYLKDTRIEIVGVNKKDPLQY AEAIDKLVSSGSFTRNEVRIM LGEEPSDNPELDEYLVTKNY EKANENGSTLKGGDEDESG D (SEQ ID NO: 686) | 82 | HK97 family phage portal protein [Staphylococcus aureus subsp. aureus JH9] | YP_001247382.1 | 1e-40 (82/82) | | | 4e-05 |
| 4 | 3207 | 3944 | MKVEIKGVIVSNEDKWVYEM LGMDSTCPKDVLTQLEFSDE DVDIIINSNGGNLVAGSEIYTH LRAHKQKVNVRITAIAASAAS LIAMAGDHIEMSPVARMMHN PSSIAQGEAKDLNHAAETLEH VGQIMAEAYAVRAGKNKQEL IEMMAKETWLNADEAIEQGF ADSKMFENDNMQIVASDTQV LSKDVLNRVTALVSKTPEVNI DIDAIANKVIEKINMKEKESEI DVADSKLSANGFSRFLF (SEQ ID NO: 687) | 245 | peptidase S14, ClpP [Staphylococcus aureus subsp. aureus JH9] | YP_001247381.1 | 1e-139 (245/245) | Clp protease | | |
| | | | | | 77ORF015 [Staphylococcus phage 77] | NP_958605.1 | 1e-138 (243/245) | Clp protease | pfam00574 | 2e-34 |

FIG. 20B

| | | | | | | |
|---|---|---|---|---|---|---|
| 5a | 3967 | 4473 | MTINLSETFANAKNEFINAVN NGEPQERQNELYGDMINQLF EETKLQAKAEAERVSSLPKS AQTLSANQRNFFMDINKSVG YKFEKLLPEETIDRIFEDLTTN HPLLADLGIKNAGLRLKFLKS ETSGVAVWGKAYGEIKGQLD AAFSEETAIQNKLTAFVVLTK RFK (SEQ ID NO: 688) | 168 | phi77 ORF006-like protein, putative capsid protein [Staphylococcus aureus subsp. aureus JH1] | YP_001317173.1 | 5e-90 (164/165) | |
| | | | | | hypothetical protein SA1774 [Staphylococcus phage phiN315] | NP_835556.1 | 1e-87 (160/165) | capsid protein | No putative conserved domains have been detected |
| 5b | 4532 | 5113 | VALETAFLKGTGKDQPIGLNR QVQKGVSVTEGAYPEKEEQ GTLTFANPRATVNELTQVFK YHSTNEKGKSVAVKGNVTMV VNPSDAFEVQAQYTHLNANG VYVTALPFNLNVIESTVQEAG KVLTYVKGLYDGYLAGGINV QKFKETLALDDMDLYTAKQF AYGKAKDNKVAAVWKLDLKG HKPALEGTEETL (SEQ ID NO: 689) | 193 | phi77 ORF006-like protein, putative capsid protein [Staphylococcus aureus subsp. aureus USA300] | YP_494589.1 | 5e-108 (193/193) | |
| | | | | | hypothetical protein SA1774 [Staphylococcus phage phiN315] | NP_835556.1 | 5e-108 (193/193) | |
| 6 | 5133 | 5360 | MVKFKVVRAFKDIEHNQHKY KVGELYPAEGYNNPRVELLT NQIKNKYDKVYVPLDKLTKQ ELLELCESLQKKDV (SEQ ID NO: 690) | 75 | hypothetical protein SA1773 [Staphylococcus phage phiN315] | NP_835557.1 | 5e-35 (73/73) | | No putative conserved domains have been detected |
| | | | | | hypothetical protein NWMN_1894 [Staphylococcus aureus subsp. aureus str. Newman] | YP_001332928.1 | 3e-49 (98/98) | |
| 7 | 5396 | 5692 | MVKTMTIDDLLVKFKSLEKID HNSEDEYLKQLLKMSYERIK NQCGVFELENLIGQELILIRAR YAYQDLLEHFNDNYRPEIIDF SLSLMEVSEDEESV (SEQ ID NO: 691) | 98 | hypothetical protein SA1772 [Staphylococcus phage phiN315] | NP_835558.1 | 1e-46 (94/94) | | No putative conserved domains have been detected |

FIG. 20C

| | | | | | | |
|---|---|---|---|---|---|---|
| 8 | 5676 | 6038 | MKKVFKKPRITTKRLNTRVHF YKYTENNGPEAGEKEEKLLY SCWASIDGVWLRELEQAISN GTQNDIKLYIRDPQGDYLPSE EHYLEIESRYFKNRLNIKQVS PDLDNKDFIMIRGGYSS (SEQ ID NO: 692) | 120 | hypothetical protein SA1771 [Staphylococcus phage phiN315] | NP_835559.1 | 2e-65 (120/120) | head-tail adapter | No putative conserved domains have been detected |
| | | | | | phage head-tail adaptor, putative [Staphylococcus aureus subsp. aureus JH9] | YP_001247377.1 | 2e-65 (120/120) | | |
| 9 | 6035 | 6439 | MSVKVIGDKALERELEKRFGI KEMVKVQDKALIAGAKVIVEE VKKQLKPSKDTGALINEVSFS KPEWINGKRTITVHWRGSKD RYKIVHLIEYGHVQKGTGKFI KPKAMGGVNRAIRQGQNKY FETLKRELKKL (SEQ ID NO: 693) | 134 | hypothetical protein SA1770 [Staphylococcus phage phiN315] | NP_835560.1 | 7e-71 (134/134) | | No putative conserved domains have been detected |
| 10 | 6436 | 6843 | VIDILYKVHEVISQDRIIREHVN INNIKFNKYPNVKDTDVPFIVI DDIDDFIPTYTYTDGDECAYSY IVQIDVFVKYNDEYNARIIRNK ISNRIQKLLWSELKMGNVSN GKPEYIEEFKTYRSSRVYEGI FYKEEN (SEQ ID NO: 694) | 135 | hypothetical protein SA1769 [Staphylococcus phage phiN315] | NP_835561.1 | 6e-71 (134/135) | | No putative conserved domains have been detected |
| 11a | 6844 | 7113 | MAIKHASAPKAYFNITGLGFA KLTKEGAELKYSDITKTRGLQ KIGVETGGELKTAYADGGPIE SGNTDGEGKISLQMHAFPKEI RKIVF (SEQ ID NO: 695) | 89 | phi13 family phage major tail protein [Staphylococcus aureus subsp. aureus JH9] | YP_001247374.1 | 2e-44 (89/89) | major tail protein | |
| | | | | | 77ORF020 [Staphylococcus phage 77] | NP_958612.1 | 1e-43 (87/89) | | |
| | | | | | hypothetical protein NM3_gp48 [Staphylococcus aureus phage phiNM3] | YP_908837.1 | 4e-43 (86/89) | | No putative conserved domains have been detected |

FIG. 20D

| | | | | | | |
|---|---|---|---|---|---|---|
| 11b | 7237 | 7488 | MFTNPKIDGETAEKDWDFSS EEVEGEALFPLVDNKKSVRK YIFDSANMTNHDGDGEKGEE AFLKKILGEEYTGNVTEGNEE TL (SEQ ID NO: 696) | hypothetical protein NM3_gp48 [Staphylococcus aureus phage phiNM3] | YP_908837.1 | 7e-41 (83/83) | | No putative conserved domains have been detected |
| 12 | 7614 | 7764 | LKYTTDQTNIVSINSDGQVTA EAQGIATVKATVGNMSDTITI NVEA (SEQ ID NO: 697) | hypothetical protein SAR2053 [Staphylococcus aureus subsp. aureus MRSA252] | YP_041424.1 | 3e-17 (46/46) | | No putative conserved domains have been detected |
| | | | | hypothetical protein NM3_gp49 [Staphylococcus aureus phage phiNM3] | YP_908838.1 | 1e-16 (45/46) | | |
| 13 | 7804 | 8154 | MAKLKRNIIQLVEDPKANEIKL QTYLTPHFISFEIVYEAMDLID DIEDENSTMKPREIADRLMD MVVKIYDNQFTVKDLKERMH APDGMNALREQVFITQGQQ TEETRNFIQNMIK (SEQ ID NO: 698) | hypothetical protein SA1767 [Staphylococcus aureus phage phiN315] | NP_835563.1 | 2e-61 (116/116) | | No putative conserved domains have been detected |
| 14 | 8193 | 8309 | MLKNMDTLMMDLIENGKDAN EVLKMPFHYVLSIYQNKNNDI S (SEQ ID NO: 699) | 77ORF100 [Staphylococcus phage 77] | NP_958614.1 | 5e-16 (42/42) | | No putative conserved domains have been detected |
| 15a | 8400 | 11051 | MGERIKGLSIGLDLDAANLNR SFAEIKRNFKTLNSDLKLTGN NFKYTEKSTHSYKQRIKELDG TITGYKKNVDDLAKQYGKVS QEQGENSAEAQKLRQEYNK QANELNFLEKELEKTTFEFEE FKKAQVEAQRMAESGWGKT SKVFESMGPKLTKMGDGLKS IGKGLMIGVTAPVLGIAAASG KAFAEVDKGLDTVTQATGAT GGELKKLQNSFKDVYGNFPE DAETVGGVLGEVNTRLGFTG KELESATESFLKFSHITGSDG | TP901 family phage tail tape measure protein [Staphylococcus aureus subsp. aureus JH9] | YP_001247370.1 | 0.0 (871/872) | tail tape measure protein | Phage-related minor tail protein |
| | | | | hypothetical protein SA1766 [Staphylococcus phage phiN315] | NP_835564.1 | 0.0 (854/870) | | COG5280 | 3e-120 |

FIG. 20E

| 15b | 11036 | 12613 | VQAVQLITRAMGDAGIEADE YQSVLDMVAKAAQASGISVD TLADSITKYGAPMRAMGFEM KESIALFSQWEKSGVNTEIAF SGLKKAISNWGKAGKDPREE FKKTLAEIERTPDIASATSLAI EAFGAKAGPDLADAIKGGRF SYQEFLKTIEDSQGTVNQTFK DSESGSERFKVAMNKLKLVG ADVWASIESAFAPVMEELIKK LSVAVDWFSSLSDGSKRSIVI FGGIAAAIGPVVFGLGAFISTV GNAVTVLAPLLASIAKADGLIS FLSTKVPILGTVFTALTGPIGI VLGVLAGLAVAFTIAYKKSET FRNFVNGAINSVKQTFSNFIQ FIQPFIDSVKNVFKQAVSAIVD FAKDIWSQINGFFNENGISIV QALQNICNFIKAIFEFILNFVIK PIMFAIWQVMQFIWPAVKALI VSTWENIKGVIQGALNIILGFI KFFSSLFTGNWRGVWDGIV MILKGTVQLIWNLIQLIWFVGKI LGVVRYFGGLLKGLISGIWGV IKGIFTKSLSAIWNATKSIFGF LYNSVKSIFTNMKNWLSSTW NNIKSNTVGKAHSLFTGVRS KFTSLWNATKDIFTKLRNWM SNIWNSIKDNTVGIAGRLWIK YVISSETCVTV (SEQ ID NO: 700) MRDGLKSIIGKIKDHIGGMVD AIKKGLNKLIEGLNWV3GKLG MDEIPRLHTGTEHTHTTRLV KNGKIARDTFATVGDKGRGN ALNGFRNEMIEFPNGIRVITP NTDTTAYLPKGSKVYNGAQT | 526 | TP901 family phage tail tape measure protein [Staphylococcus aureus subsp. aureus JH9] | YP_001247370.1 | 0,0 (521/524) | | Phage-related protein | COG5412 | 7e-62 |
|---|---|---|---|---|---|---|---|---|---|---|

FIG. 20F

| | | | | | | |
|---|---|---|---|---|---|---|
| 15c | 12888 | YSMLNGTLPRFHFGTTMWK DIKSSASSAFNWTKDQIGKG TKWNLGDKVGDVLDFMENPG KLLNYILEAFGIDFNSLTKGM GIAGDITKAAWSKIKKSSATDW IKENLEAMGGGDLVGGILDP DKINYHYGRTAAYTAATGRP FHEGVDFPFVVQEVRTPMG GRLTRMPFMSGGYGNYYKIT SGVIDMLFAHLKNFSKSPPS GTMVKPGDVVGLTGNTGFST GPHLHFEMRRNGRHFDPEP YLRNAKKKGRLSIIGGGGATS GSGATYASRVIRQAQSILGG RYKGKWIHDQMMRVAKRES NYQSNAVNIWDINAQRGDP SRGLFQIIGSTFRANAKRGYT NYNNPVHQGISAMQYIVRRY GWGGFKRAGDYAYATGGKV FDGWYNLGEDGHPEWIIPTD PARKK (SEQ ID NO: 701) | | phage tail tape measure protein [Staphylococcus aureus phage phiNM3] | ABF73212.1 | 0.0 (510/524) | LT_GEWL, lytic transglycosyl ase (LT) and goose egg white lysozym e (GEWL) domain | cd00264 | 1e-06 |
| | 12930 | LSNVNGFDDPSLLLKMIEQQ QQQIALLLKIAQSNDVIADKD YQPIIDEYAFDKKVNASIEKRE RQESTKVKFRKGGIAIQ (SEQ ID NO: 702) | 80 | TP901 family phage tail tape measure protein [Staphylococcus aureus subsp. aureus JH9] | YP_001247370.1 | 5e-39 (80/80) | | | |
| 16a | 12927 | MIDTIKVNNKTIPWLYVERGF EIPSFNYVLKTENVDGRSGSI YKGRRLESYSFDIPLVVRNDY LSHNGIKTHDDVLNELVKKFFN YEEQVKLQFKSKDWYVVNAY FEGPIKLHKEFAIPVKFTIKVV LTDPYKYSVTGNKNTAISDQV SVVNSGTADTPLIVEARAIKP SSYFMITKNDEDYFMVGDDE | 382 | hypothetical protein SA1766 [Staphylococcus phage phiN315] | NP_835564.1 | 2e-38 (79/80) | No putative conserved domains have been detected | | |
| | 14075 | | | hypothetical protein SA1765 [Staphylococcus phage phiN315] | NP_835565.1 | 0.0 (357/359) | tail fiber protein | | |
| | | | | phage tail fiber protein [Staphylococcus aureus subsp. | YP_001332921.1 | 0.0 (355/359) | No putative conserved domains have been detected | | |

FIG. 20G

| | | | | | | | |
|---|---|---|---|---|---|---|---|
| 16b | 14054 | | VTKEVKDYMPPVYHSEFRDF KGWTKMITEDIPSNDLGGKV GGDFVISNLGEGYKATNFPD AKGWVGAGTKRGLPKAMTD FQITYKCIVEQKGKGAGRTA QHIYDSDGKLLASIGYENKYH DRKIGHIVVTLYNQKGDPKKI YDYQNKPIMYNLDRIVVYMRL RRVGNKFLLKLGNUTLKTQID VNLLIWMRKSG (SEQ ID NO: 703) | hypothetical protein PVL_18 [Staphylococcus phage PVL] | NP_058457.1 | 9e-137 (239/242) | |
| | 14410 | | MDEKEWDGGKFYQRPASIIA IYSAKYNGYKMMEMNGLGS FNTEILPKPKGARDVIICKGDL VKIDMQAKSVVINEEPMLSEK SFGSNYFNVDSGYSELJIQPE NVFDTTVKWQDRYL (SEQ ID NO: 704) | 118 | hypothetical protein PVL_18 [Staphylococcus phage PVL] | NP_058457.1 | 2e-63 (118/118) | No putative conserved domains have been detected |
| | | | | phage tail fiber protein [Staphylococcus aureus subsp. aureus str. Newman] | YP_001332921.1 | 2e-63 (118/118) | |
| 17a | 16798 | | VIHVLDFNDK(IDFLSTDDPSL VRAIHKRNVNDNSEMLELLIS SERAEKFRERHRVIIRDSNKQ WREFIINWVQDTMDGYTEIE CIASYLADITTAKPYAPGKFE KKTTSEALKDVLSDTGWEVS EQTEYDGLRTTSWTSYQTRY EVLKQLCTTYKMVLDFYIELS SNTVKGRYVVLKKKNSLFKG KEIEYGKDLVGLTRKIDMSEIK TALIAVGPENDKGKRLELVVT DDEAQSQFNLPMRYIWGIYE PQSDDQNMNETRLSSLAKTE LNKRKSAVMSYEITSTDLEVT | 790 | phage minor structural protein [Staphylococcus aureus subsp. aureus JH9] | YP_001247368.1 | 0,0 (787/788) | minor structural protein |
| | | | | 77ORF002 [Staphylococcus phage 77] | NP_958617.1 | 0,0 (784/788) | TolA protein pfam06519 4e-04 |
| 14426 | | | | structural protein [Staphylococcus phage phi13] | NP_803398.1 | 0,0 (747/752) | |

FIG. 20H

| | | | | | |
|---|---|---|---|---|---|
| 17b | 167/67 | 18209 | MQPIVHFQYIKRDCPNVTDG TTIRYDDNGVAQALNVGPRGI RLNADKIDINGNREINLLIQNM RDKVDKTDIVNSLNLSREGLD INVNRIGIKGGNNNRYVQIQN DSIELGGIVQRTWKGKRSTD DIFTRLKDGHLRFRNNTAGG SLYMSHFGISTYIDGEGEDG GSSGTIQWWDKTYSDSGMN GITINSYGGVVALTSDNNRVV LESYASSNIKSKQAPVYLYPN TDKVPGLNRFAFTLSNADNA YSSDGYIMFGSDENYDYGAG IRFSKERNKGLVQIVNGRYAT GGDTTIEAGYGKFNMLKRRD GNRYIHQSTDLLGVGSDDAG DRIASNSIYRRTYSAAANLHIT SAGTIGRSTSARKYKLSIENQ YNDRDEQLEHSKAILNLPIRT WFDKAESSHILARELREDRKLS EDTYKLDRYVGLIAEEVENLG LKEFVTYDDKGEIEGIAYDRL WIHLIPVIKEQQLRIKKLEESK NAG (SEQ ID NO: 706) | 480 | structural protein [Staphylococcus phage phi13] | NP_803398.1 | 0.0 (465/467) | No putative conserved domains have been detected |
| 18 | 18199 | 18351 | MQDNKQGLQANPEYTIHYLS QEIMRLTQENAMLKAYIQENK ENQQGAEEE (SEQ ID NO: 707) | 50 | hypothetical protein phiPV83p56 [Staphylococcus prophage phiPV83] | NP_061644.1 | 2e-20 (50/50) | No putative conserved domains have been detected |
| 19 | 18398 | 18619 | MAKEIINNTERFILVQIDKEGT ERVVYQDFTGSFTTSEMVNH AQDFKSEENAKKIAETLNLLY QLTNKKQRVK (SEQ ID NO: 708) | 73 | hypothetical protein PVL_21 [Staphylococcus phage PVL] | NP_058460.1 | 4e-35 (73/73) | No putative conserved domains have been detected |
| 20 | 18808 | 19038 | MLSTLNEIKLGQKTQEQVNIK LDKTLDAIQKEREIDEKNKKE NDKNIRDMKMWVLGLVGTIF GSLIIALLRMLMGI (SEQ ID NO: 709) | 76 | phi PVL orf 17-like protein [Staphylococcus phage phi13] | NP_803400.1 | 3e-34 (76/76) | No putative conserved domains have been detected |

FIG. 20J

| | | | | | | | |
|---|---|---|---|---|---|---|---|
| 21 | 19230 | 18364 | MVALLKSLERRRLMITISTML QFGLFLIALIGLVIKLIELSNKK (SEQ ID NO: 710) | 44 | hypothetical protein SAR2042 [Staphylococcus aureus subsp. aureus MRSA252] | YP_041413.1 | 8e-15 (44/44) | | No putative conserved domains have been detected |
| | | | | | ORF087 [Staphylococcus phage 42E] | YP_239882.1 | 4e-14 (43/44) | | |
| 22 | 19629 | 19832 | LSAIFLFAQNIAKAIGYDIQVY TEQLTDGLNAILGFLVLTGVIQ DPTTKGIGDSHQALEYEEPR RKY (SEQ ID NO: 711) | 67 | holin [Staphylococcus aureus subsp. aureus str. JKD6008] | ZP_03564466.1 | 9e-32 (37/67) | holin | Phage_holin_1 | pfam04531 | 1e-22 |
| | | | | | holin [Staphylococcus prophage phiPV83] | NP_061647.1 | 5e-31 (66/67) | | | |
| 23 | 19844 | 20599 | MKTYSEARARLRWYQGRYID FDGWYGYQCADLAWDYIYWL LEIRMWGNAKDAINNDFKNM ATVYENTPSFVPQIGDVAVFT KGIYKQYGHIGLVFNGGNTN QFLILEQNYDGNANTPAKLR WDNYYGCTHFIRPKYKGEGL MNKITNKVKPPAQIKAVGKSA SKITVGSKAPYNLKMSKGAY FNAKIDGLGATSATRYGDNR TNYRFDVGQAYYAPGTLIYVF EIIDGWCRIYWNHNEWIWH ERLIVKEVF (SEQ ID NO: 712) | 251 | amidase [Staphylococcus phage phi13] | NP_803402.1 | 2e-146 (251/251) | CHAP endolysin | CHAP domain | pfam05257 | 1e-17 |

FIG. 20K

| # | | | Sequence | | | | | |
|---|---|---|---|---|---|---|---|---|
| 24 | 20790 | 21281 | MLKRGLLFLTVLLLFSFSSIT NEVSASSSFDKGKYKKGDDA SYFEPTGPYLMVNTGVDGK GNELLSPHYVEFPIKPGTTLT KEKIEYYVEWALDATAYKEFR VVELDPSAKIEVTYYDKNKKK EETKSFPITEKGFVVPDLSEHI KNPGFNLITKVIIEKK (SEQ ID NO: 713) | 163 | staphylokinase precursor [Staphylococcus aureus phage phiNM3] | YP_908850.1 | 5e-88 (163/163) | staphylokinase precursor | Staphylokinase / Streptokinase family | pfam02821 | 8e-18 |
| 25 | 21970 | 22266 | VPAGYTLDKNNVPYKKETGY YTVANVKGNNVRDGYSTNS RITGVLPNNATIKYDGAYCIN GYRMTYIANSGQRRYIATGE VDKAGNRISSFGKFSAV (SEQ ID NO: 714) | 98 | peptidoglycan hydrolase [Staphylococcus phage phi 12] | NP_803355.1 | 3e-49 (96/98) | cell wall hydrolase remnant | Bacterial SH3 domain | pfam08460 | 1e-05 |
| 26 | 22810 | 23361 | MKKKLATTVLALSFLTAGIST HHHSAKAFTTEPFPTNEEIES NKKMLEKEKAYKESFKNSGL PTTLGKLDERLRNYLKKGTK NSAQFEKMVILTENKGYYTV YLNTPLAEDRKNWELLGKMY KTYFFKKGESIKSSYVINGPG KTNEYAY (SEQ ID NO: 715) | 149 | chemotaxis-inhibiting protein CHIPS [Staphylococcus aureus phage phiNM3] | YP_908852.1 | 8e-80 (149/149) | chemotaxis-inhibiting protein | Chemotaxis-inhibiting protein CHIPS | PRK13032 | 1e-64 |
| 27 | 23495 | 23845 | MKIRKSILAGTLAIVLASPLVT NLDKNEAQASTSLPTSNEYQ NEKLANELKSLLDELNVNELA TGSLNTYYKRTKISGQKAMY ALKSKDFKKMSEAKYQLQKIY NEIDEALKSIY (SEQ ID NO: 716) | 116 | Staphylococcal complement inhibitor [Staphylococcus aureus phage phiNM3] | ABF73224.1 | 1e-58 (116/116) | staphylococcal complement inhibitor | | No putative conserved domains have been detected | |
| 28 | 24234 | 24389 | LVNKINKFNQYVARFIPYIATK IPIKKNIAPMIKQKSDAELLKN EVFRVRK (SEQ ID NO: 717) | 51 | hypothetical protein NM3_gp65 [Staphylococcus aureus phage phiNM3] | YP_908854.1 | 6e-20 (50/51) | | | No putative conserved domains have been detected | |

FIG. 20L

| | | | | | | | |
|---|---|---|---|---|---|---|---|
| 29 | 26143 | MKTRCYDGKKMQYEFKYEG KRYRKKGFRTKREANSAGLD KLNELRSGFNIDNYITLEEYFE NWIKTYKQPVVKENTYRHYR NALQHIQKHKIGKMELSKINR QVYQKFINDYSKEHAKETIRK TNGAIRSALDDALYDGLIFKN PAYKVNYKAGKPTKSEQEKFI SVTEYEILKDHVRKRTRSSL ALFIMICTGCRVSGARNIKIEH INQVKNTIFIDERKTDTSPRYI SIAKSDMKHIMDVISTFAISYD GYIFKEAGSIINLQAINNALKS ACRVNNIPIITSHALRHTHCSY LLAKQVSIHYISKFLGHKNFAI TTSVYSHLLEEKFNEEDKKTT KILESM (SEQ ID NO: 718) | 345 | phage integrase family protein [Staphylococcus aureus subsp. aureus JH9] | YP_001247419.1 | 0,0 (345/345) | integrase | phiLC3 phage and phage-related integrases | cd01189 | 1e-34 |
| | 26106 | | | Integrase [Staphylococcus phage phiN315] | NP_835517.1 | 0,0 (343/345) | | | |
| 30 | 27088 | LNGGESVSENKGEMMTHNIE KRINKLKTSGNPKFKKLDSDI HYLLKRFEGEKNHKGFYPKF KQGEIVFVDFGINVNKEFSNS HFAIVMNKNDSNTEDIVVNIP LSSKENKKYLKMNPDLKWEY YLRLFLMLISAQNNSAILKEVS IKNTKKQHRIHH (SEQ ID NO: 719) | 157 | hypothetical protein SaurJH9_2059 [Staphylococcus aureus subsp.aureus JH9] | YP_001247418.1 | 2e-73 (137/138) | | Uncharacterized protein conserved in bacteria (DUF2234) | pfam09993 | 0,005 |
| | 26615 | | | 77ORF017 [Staphylococcus phage 77] | NP_958624.1 | 3e-69 (130/130) | | | |
| 31 | 27151 | MKITNGKIKRETIVYEVLTSGN QPFTYELPKDLSSHNARKYL EFISQKIRWR (SEQ ID NO: 720) | 52 | hypothetical protein SaurJH9_2058 [Staphylococcus aureus subsp. aureus JH9] | YP_001247417.1 | 3e-21 (49/49) | | No putative conserved domains have been detected | | |
| | 27309 | | | hypothetical protein phi12p03 [Staphylococcus phage phi 12] | NP_803309.1 | 8e-21 (48/49) | | | |

FIG. 20M

| | | Sequence | | | | | |
|---|---|---|---|---|---|---|---|
| 32 | 27565 | MSTYKEIEHLHINTGGKELTQ EQIEEAKAFIDSQEFKDMIRE AKESHQRVMESKITDRTKL (SEQ ID NO: 721) | 61 | hypothetical protein SaurJH9_2057 [Staphylococcus aureus subsp. aureus JH9] | YP_001247416.1 | 4e-27 (61/61) | | No putative conserved domains have been detected |
| | | | | hypothetical protein phiPV83p04 [Staphylococcus prophage phiPV83] | NP_061594.1 | 1e-25 (58/61) | | |
| 33 | 27708 | MDFKEVDINIEEWEMVEIPFY TEEELTYRLNNGLPITKSELE EQESKK (SEQ ID NO: 722) | 48 | hypothetical protein SaurJH9_2056 [Staphylococcus aureus subsp. aureus JH9] | YP_001247415.1 | 9e-19 (48/48) | | No putative conserved domains have been detected |
| | | | | hypothetical protein phiETA_05 [Staphylococcus phage phiETA] | NP_510899.1 | 1e-17 (46/48) | | |
| 34 | 28635 | MKPRKQDEKILSDQYSYFEPI ISDSCDIKFDENKRRMGSIFIS HEEICFIRKEEDYIFKISLSEVI DYNTVVTIWKNQAFLTLNDN RKLTVYFVTNSPLTGFISILKT YMQLSKNKETIISNDCLPIND DEQTKVEIFDVVGLNYEGRR KELKLIKKMKNNDDFFFLYS DLKGNELKEELLYEDKVYEIS DYEVIPGVFLQKEPDNPYDE NAIKVMISNEYSEFHVGYVPR EYASRLVNHMDNIVSCNAYIN GGKYKT (SEQ ID NO: 723) | 259 | HIRAN [Staphylococcus aureus subsp. aureus JH9] | YP_001247414.1 | 7e-148 (259/259) | DNA binding protein, putative helicase | HIRAN domain |
| | | | | SNF2 family helicase, putative [Aspergillus fumigatus A1163] | EDP51408.1 | 3e-4 (22/46) | | pfam08797 7e-11 |
| 35 | 29361 | MNSFKDRLKQIMSERKISQS ELSRRTGIGRNSISDYLNGKY EAKQDKVFELAKALNVNEAW LMGFDISKNRKIENNDITSIYS KLTPPRQSNVLKYATNQLEE | 224 | putative phage repressor [Staphylococcus aureus subsp. aureus JH9] | YP_001247413.1 | 4e-125 (221/221) | cI-like repressor | Peptidase S24 LexA-like proteins cd06529 1e-15 |

FIG. 20N

| | | | | | | | | |
|---|---|---|---|---|---|---|---|---|
| 36 | 29526 | | QNNDSDNLVDFNSYIQEKSE VDIYGCASAGIGERLYNEPIS KEFVRGYVPAHDIALKVNGD SMEPLFKNGQIIFIEKSHTIKD GQIGVFIINGDAYVKKVYVED NRLTLVSLNKKYKDYIL (SEQ ID NO: 724) | similar to phage phi PVL repressor [Staphylococcus phage phiETA] | NP_510900.1 | 1e-99 (174/221) | | |
| 37 | 29788 | 80 | MIYNFDYSLLYERMAEYRYS QSSLANAIPISRTSINHKLQGK NLFTQWEIKRICELLEIPPTKV/ GRYFEQNVQKPVQMS (SEQ ID NO: 725) | hypothetical protein SauJH9_2053 [Staphylococcus aureus subsp. aureus JH9] | YP_001247412.1 | 1e-40 (80/80) | cro-like repressor | Helix-turn-helix XRE-family like proteins | cd00093 | 0.006 |
| | | 37 | MEQITLTKEELKEIIAKEVRNA IKGEKPISSGAISVK (SEQ ID NO: 726) | putative cro-like repressor [Staphylococcus phage phiPVL108] | YP_918897.1 | 3e-39 (78/80) | | | |
| | 29781 | | | hypothetical protein phiPV83pO7 [Staphylococcus prophage phiPV83] | NP_061597.1 | 2e-10 (35/37) | | No putative conserved domains have been detected | |
| 38 | 30241 | 46 | MLQKFRIAKEKNKLKLKLLKH ASYCLERNNNPELLRAVAELL KKVS (SEQ ID NO: 727) | hypothetical protein phiPV83pO8 [Staphylococcus prophage phiPV83] | NP_061598.1 | 1e-16 (46/46) | | No putative conserved domains have been detected | |
| 39 | 30583 | 69 | MKLLVTLKDGSKKHVSDLKKI VFPGYEGIETVTKEEIETFELD PTKTYVFVGSQTLSVEAGQIL TVEFS (SEQ ID NO: 728) | 77ORF066 [Staphylococcus phage 77] | NP_958632.1 | 9e-31 (69/69) | | No putative conserved domains have been detected | |
| 40 | 30840 | | MQALKTKSNIQEMFNIQEKE NGEIAISARELYKALEVKKRF SAVWAEINLKIHFKENRDFTSVL TSTVVNNGAVRQLEDYALTL DVAKHVAMMSGTEKGFDFR EYFIQVEKAVVNSPEMIMQRA LKIANINTINQLETKIERDKPKI VFADAVATTKTSILVGELAKI KQNGINIGQRRLFEWLRQNG FLIKRKGVDYNMPTQYSMER | phage anti-repressor [Staphylococcus aureus subsp. aureus MW2] | NP_646749.1 | 4e-142 (245/245) | antirepressor | ANT, phage antirepress or protein KilAC domain | | |
| | 31500 | 286 | | anti-repressor [Staphylococcus phage phiSauS-] | YP_002332482.1 | 9e-142 (244/245) | | | pfam03374 | 4e-36 |

FIG. 200

| | | | | IPLA88] | | | | | |
|---|---|---|---|---|---|---|---|---|---|
| | | | ELFEIKETSITHSDGHTSISKT PKVTGKGQQYFVNKFLGENK QLNRRNEQCKLKTKKSSITT MTKKVIDDPLIFNTTMATT (SEQ ID NO: 729) | | | | | | No putative conserved domains have been detected |
| 41 | 31500 | 31601 | MIDQRFIEMTLERHPHLKNNF YGLIDGKEFKLD (SEQ ID NO: 730) | 33 | hypothetical protein PVL_35 [Staphylococcus phage PVL] | NP_058474.1 | 2e-11 (33/33) | | |
| 42 | 31968 | 31588 | MKLDHDCVRHLLLEIETNKKI GEPLTEYNFKDNIVFGKYDF ETVMYALLKLEEAKYVSVKF GWEDGHIYGYTINDITWSGH EFLDNIRDNHTWKEVKKVAN KTTSMSVTLLSKLAFNYLTQK FNLT (SEQ ID NO: 731) | 126 | hypothetical protein PVL_36 [Staphylococcus phage PVL] | NP_058475.1 | 6e-68 (126/126) | Hypothetical protein (DUF2513) | pfam10711 | 2e-28 |
| 43 | 32023 | 32346 | MPHILNVTVPIPETHVLITKDE YEELIAYSLDPVWNMSDLKK KLKIASDETIKDRLLFHPRLEK ELRAQGIVHYPDENFNRWRF NARRMHKFVDEHFNEIYKGG HNK (SEQ ID NO: 732) | 107 | hypothetical protein SA1799 [Staphylococcus phage phiN315] | NP_835529.1 | 8e-57 (107/107) | Uncharacterized protein conserved in bacteria [Function unknown] | COG4707 | 3e-37 |
| 44 | 32343 | 32504 | MSKTYKSYLVAVLCFTVLAIV LMPFLYFTTAWSIAGFASIAT FIFYKEYFYEE (SEQ ID NO: 733) | 53 | hypothetical protein SAS063 [Staphylococcus phage phiN315] | NP_835530.1 | 2e-21 (53/53) | Protein of unknown function (DUF1270) | pfam06900 | 1e-10 |
| 45 | 32599 | 32901 | MTKNYKDMTQEEIKDLLSEK TAELYELAKEIKGESKFDILLF SSIGVIDGDYLAGSSSVIGHT FDLAYLLDSTKSYKDIVNVLQ MCKSQKILGIDDDKED (SEQ ID NO: 734) | 100 | hypothetical protein SA1798 [Staphylococcus phage phiN315] | NP_835553.1 | 7e-49 (100/100) | Hypothetical protein of unknown function (DUF2482) | pfam10655 | 3e-39 |

FIG. 20P

| | | | | | | | |
|---|---|---|---|---|---|---|---|
| 46 | 32906 | 33166 | MYYKTGDVCRKIFNVDGFDF QLRVKKRAYSVEIWLDHEG NSIDGLLVSDENDLYTALDILK QSIYEWIENNTDEQDRLINLV MKW (SEQ ID NO: 736) | hypothetical protein SA1797 [Staphylococcus phage phiN315] | NP_835532.1 | 9e-43 (86/86) | Protein of unknown function (DUF1103) | pfam06531 | 7e-35 |
| 47 | 33160 | 33438 | MVGISMRDTERNILNIFKTLF DEYTLSNQRALLEIERNHHG YLSINFLHYHDSYKTNNKLVQ IHEINPDSHERIKNLIIEVLRGH RKIKKGA (SEQ ID NO: 736) | hypothetical protein NM3_gp18 [Staphylococcus aureus phage phiNM3] | YP_908807.1 | 3e-46 (92/92) | No putative conserved domains have been detected | | |
| 48 | 33447 | 35390 | MKINKLTISNFAGIKEEKFNFD GKDAKIYGNNATGKTTTATAL QWLLFDKGLDGSTKSFNPVP LMEKNEENYELIPTVFAEFEID GKITTFKKESHPKYTINQKTN RKEYSRSRTKKQYINDESIKV KDYKARIDELIDEDVFKLITNP QAFNLLDWKKRRSILLFEIAKP INDEDVIKTNDDFKELNNILGD HEIETKKKILTDKIKQINKDIKD IPIRINQTQQNKQDVPEFDND RHTIIKQEIEQLENERIDIQNG AEEINLRNQLADKQSELKRIE ANNSASNENKIHALTNELHVE NGTVANILKTRLKQNKQQITH EENRRNQLLENHKGLKSDLE KAKNQKFEYLDDNVCSCCG QQLPAEQVSEVREKALQKFN ANKSKELETIQTSINHIHSEGK KIKPIIEKLEDDNNNLQIKINEA EERSARIQNKINKLKITHVDVT QTDEYKAVMLEINEINQKRSN IRKTIQDKVSGIDDKISELTQE KSEIEVSISIEKSNKHLDDVIS ELRNEEDRLLDEKEKYSHDL YILKEFTTTKVKMLTENINNEF DIAEFKLFNTLVNGELEETCS TTVNGVEYDSGLNNASRINV GLDIINTLSKHFKVTAPIFIDNA ESVTELIKTESQQIQLIVNEQD | hypothetical protein SA1795 [Staphylococcus phage phiN315] | NP_835534.1 | 0.0 (647/647) | SMC_N, RecF/RecN /SMC N terminal domain | pfam02463 | 7e-06 |

FIG. 20Q

| | | | | | | | | | |
|---|---|---|---|---|---|---|---|---|---|
| 49 | 36513 | KKLRMETI (SEQ ID NO: 737) | | | | | | | |
| | 36313 | MKSAMLQLQELKGSKKDGY KPALEFATSTSIANALMDMVV QGLNPAKNQGYFIMYGDKVQ FQRSYHGTMAVTKRVAGAE EINAEVIFEQDEVKYKTKNGKI VELEHTQSFGNRNTQNIIGAY ATVVFKDESRNYTEIMTFEEI EEAWKQSQMVYNGVFKEDG THRRFPQEMAKKTVINRACK KILNSTDDASLLSNQIKESEQ RQRKEVLDAEVEENANQEQL DFEPPVFEEAQYTELENEKPI DVSDFEEIKEPATEKESEEEP F (SEQ ID NO: 738) | 266 | NP_835535.1 | 2e-154 (266/266) | hypothetical protein SA1794 [Staphylococcus phage phiN315] | recombinase | RecT, recombinati onal DNA repair protein (RecE pathway) | COG3723 | 6e-65 |
| 50 | 36526 | MTAGTQRAMDFESHRLCTIK AKQELRIGTWSILPFDIEHDA NEPVAFLLQSTLGYKVLYYTD TKYLKYKFNGITHMMLEVNYI YEQMQENIKNGSVHSALANR IMESHFSLEHAIGMLKANDLT RLEEIHLIHLSSQNSNAKYIKS EIQKVTGAPVYVGGL (SEQ ID NO: 739) | 161 | NP_93553.1 | 2e-91 (161/161) | hypothetical protein SA1793 [Staphylococcus phage phiN315] | partial metallo-beta-lactamase domain | PhnP, Metal-dependent hydrolases of the beta-lactamase superfamily | COG1235 | 1e-14 |
| 51 | 37011 | MLNRTILVGRLTRDPELRTTQ SGVNVASFTLAVNRTFTNAQ GEREADFINIIVFKKQAENVN KYLSKGSLAGVDGRLGTRNY ENKEGQRVYVTEVIADSIQFL EPKNSNDTQQDLYQQQVQQ TRGGSQYSNNKPVKDNPFA NANGPIEIDDNDLPF (SEQ ID NO: 740) | 156 | NP_835537.1 | 3e-85 (156/156) | single-strand DNA-binding protein [Staphylococcus phage phiN315] | ssDNA binding protein | single-strand DNA-binding protein | PRK06751 | 1e-40 |
| | 37012 | | | | | | | | |
| | 37482 | | | | | | | | |

FIG. 20R

| | | | | | | | |
|---|---|---|---|---|---|---|---|
| 52 | 37512 | 38348 | MTGWSIDRSIQNHWLFKEK RTFSKFEAWYLLMEAMHSK AKVPIGNQIVTVERGQRLTSIL TLSDLFNAVSRFKVKTFLDLLE SDGMLEVKTTSKYTLITVNY DFYQSEQGRNQHQNDIKPTS KQHQSNINPTSKQHQTNTNN NDNKDNNEKNVNNEKKKTTA FDFFQDNGFGFHTSYNLDDLN YYLDSFENDSDEIVTASLKIAK DRNKVTWGYAKSILNTWLNA NLKSIEQVRAFEKQQLESKK QNYKPFVKQSKEKTTQMAH RQHERNENAGSR (SEQ ID NO: 741) | hypothetical protein SA1791 [Staphylococcus phage phiN315] | NP_835538.1 | 5e-150 (261/263) | primosome component | DnaD, putative primosome component and related proteins | COG3935 | 9e-37 |
| 53 | 38413 | 38631 | MDAFDKYYLFDHDGNKMFS VTPHFKDGRHLVVGIKETKFN GRRWVLDDYELNTLIDNEQM ELGHQTSLFEYI (SEQ ID NO: 742) | hypothetical protein SA1790 [Staphylococcus phage phiN315] | NP_835539.1 | 2e-35 (72/72) | | No putative conserved domains have been detected | |
| 54 | 38628 | 39044 | MRDYMEIEIKFNEVFNAPMG SPRPRFRNTGRFVQTYMPTS YTKHKAYIQGQMPKLNLERA LKIELDFYFPLLKSWSKKKKS EMVGQYKVTKPDIDNLIKTVL DACNGHVWKDDNQITEITSS KRYGIEPKIIRIEEI (SEQ ID NO: 743) | hypothetical protein SA1789 [Staphylococcus phage phiN315] | NP_835540.1 | 5e-74 (134/134) | endodeoxy- ribonuclease | Endodeoxy- ribonuclease RusA | pfam05866 | 4e-22 |
| 55 | 39057 | 39428 | MARKARIVTINDKPYRFSKFE MELIESHGITAGMIVSKRVKD GWELHEAMDAPEGTRLSEY REKKTIERLEQARLERKLERK RKREAELRRKPHLFNVPQK HSRDPYWFDNTYNQMFKKW SEA (SEQ ID NO: 744) | hypothetical protein SA1788 [Staphylococcus phage phiN315] | NP_835541.1 | 3e-66 (123/123) | | PVL ORF- 50-like family | pfam07768 | 3e-34 |

FIG. 20S

| | | | | | | | |
|---|---|---|---|---|---|---|---|
| 56 | 39428 | 39685 | MSVISNRKVDMNEIQDNVKQ PAHYTYGDIEIIDFIEQVTAQY PPQLAFAIGNAIKYLSRAPLK NGHEDLAKAKFYVQRAFDLW EQ (SEQ ID NO: 745) | hypothetical protein SA1787 [Staphylococcus phage phiN315] | NP_835542.1 | 1e-43 (85/85) | No putative conserved domains have been detected |
| 57 | 39935 | 39685 | VPGWQSVKKTFDTAEELEIYI KQHGLEYEEQKQLTLF (SEQ ID NO: 746) | hypothetical protein SA1786 [Staphylococcus phage phiN315] | NP_835543.1 | 2e-13 (37/37) | Phage conserved open reading frame 51 — pfam06194 — 2e-10 |
| 58 | 39935 | 40189 | MEMMNNREQIEQSVISASAY NGMDTEGLLKEIEDYYKKAR AFDEILDGMTNAIQHSVKEGI ELDEAVGIMAGQVIYKYEEEQ GK (SEQ ID NO: 747) | hypothetical protein SA1785 [Staphylococcus phage phiN315] | NP_835544.1 | 2e-39 (82/82) | Protein of unknown function (DUF1024) — pfam06260 — 6e-26 |
| 59a | 40186 | 40491 | MTNTLTIDQLQELLQIQKKFD DRIPTRNLNDTVASMIIEFAE WWNTLEFFKNWVKKQPGKPL DTQLDEIADYLAFSLQLTLTIV DEEDLEETTEVMVDLIRK (SEQ ID NO: 748) | hypothetical protein phiPV83p30 [Staphylococcus prophage phiPV83] | NP_061619.1 | 6e-50 (99/99) | dUTPase — dUTPase_2 — pfam08761 — 4e-06 |
| 59b | 40488 | 40724 | MKLLYLNYIQFIFVHVMHTLT EQFVKGIDNSIVQVLIMPFLYA NTYYTIDQLIDAYKKMKRNH ERQDGTADAGKGYV (SEQ ID NO: 749) | hypothetical protein phiPV83p30 [Staphylococcus prophage phiPV83] | NP_061619.1 | 2e-32 (66/66) | No putative conserved domains have been detected |
| | 40761 | 41006 | VSDMLEIFLIGFGVYLFYRIAII FLKSK4TIHTNIYEMLMLATIF MISTIAYKHQKTHILIAFLVMF FMSKLKQVQGSYEE (SEQ ID NO: 750) | hypothetical protein SauraJK_03538 [Staphylococcus aureus subsp. aureus str. JKD6008] | ZP_03562520.1 | 1e-37 (80/81) | |
| 60 | | | | ORF063 [Staphylococcus phage 52A] | YP_240865.1 | 5e-37 (79/81) | No putative conserved domains have been detected |

FIG. 20T

| | | | | | | | |
|---|---|---|---|---|---|---|---|
| 61 | 41003 | 41209 | MTQYLVTTFKDSTGQPHEHF TTARDNQTFTVVEAESKEEA ERKYEAQVKRGAVIKLGQLF ENIRECGK (SEQ ID NO: 751) | 68 | hypothetical protein SA1782 [Staphylococcus phage phiN315] | NP_835547.1 | 1e-32 (68/68) | | Protein of unknown function (DUF1381) | pfam07129 | 1e-11 |
| 62 | 41206 | 41355 | MIKQILRLLFLLAMYELGIKYVT EQVYIMMTANDDVEAPSDYV FRAEVSE (SEQ ID NO: 752) | 49 | hypothetical protein SAS062 [Staphylococcus phage phiN315] | NP_835548.1 | 5e-20 (49/49) | transcriptional activator | Transcriptional activator RinB | pfam06116 | 2e-15 |
| 63 | 41355 | 41555 | MWITMTIVFAILLLVCISINSDH AREIQALRYMNDYLLDEVVKT KGYNGLEEYRNELKRINNDIK K (SEQ ID NO: 753) | 66 | hypothetical protein SA1781 [Staphylococcus phage phiN315] | NP_835549.1 | 2e-30 (66/66) | | Protein of unknown function (DUF1514) | pfam07438 | 8e-22 |
| | | | | | hypothetical protein SA1780 [Staphylococcus phage phiN315] | NP_835550.1 | 2e-75 (138/138) | | | | |
| 64 | 41583 | 41999 | MIKIEKHDIKKLEEYIQHIDNY RRELKMREYELLESHEPDNA GAGKSNLPGNPIERCAIKKFS DNRYNTLRNRNVNGVERLIDES DEDTLELLRFRYWDCPIGCY EWEDIAHYFGTSKTSILRRRN ALIDKLAKYIGYV (SEQ ID NO: 754) | 138 | RinA family phage transcriptional regulator [Staphylococcus aureus subsp. aureus JH9] | YP_001247386.1 | 2e-75 (138/138) | transcriptional regulator | No putative conserved domains have been detected | | |

FIG. 20U

| Phage | Titer (pfu/ml) | Phage sensitivity (%) of STA strains (n=100) | | | | | Total of infected strains (%) |
|---|---|---|---|---|---|---|---|
| | | ++++ | +++ | ++ | + | - | |
| F91a/06 | $5 \times 10^8$ | 0 | 42 | 29 | 14 | 15 | 85 |
| | $5 \times 10^7$ | 0 | 12 | 17 | 16 | 55 | 45 |
| | $5 \times 10^5$ | 0 | 2 | 0 | 0 | 98 | 2 |
| | $5 \times 10^3$ | 0 | 0 | 1 | 1 | 98 | 2 |

FIG. 21

| orf | Start position | Stop position | Aminoacidic sequence | Size (aa) | Homologous/similar proteins | | | | Conserved Domains | | |
|---|---|---|---|---|---|---|---|---|---|---|---|
| | | | | | Name[organism] | Acc No | E value and identity | Predicted function | Name | Acc No | E value |
| 1 | <1 | 85 | GFDVTIEPIAQDKYFLVDSKQ IREYRG (SEQ ID NO: 761) | 27 | No significant similarity found | | | | | | |
| 2 | 87 | 584 | MFLKLFIAIYTEQHLNAAKNE LERLGYKCTSDFHSALDQPV THITTYPNGTYTWTLDLDMC RRLARANTTVRVINLRQLRG VHRRLRTSFSQDNHSKLEIV PVRSVNIFPELEKLSPLETEA MQAAIKWSSPKVPTPNVFFK LWYNTAISWTKAIVNRLVRH FK (SEQ ID NO: 762) | 165 | No significant similarity found | | | | No putative conserved domains have been detected | | |
| 3 | 594 | 767 | VSKIKMNEYRGKPPYSMDDL AEDPQLERRYIQRERRNHVK ERDLDRRNKRQAKRNGY (SEQ ID NO: 763) | 57 | No significant similarity found | | | | No putative conserved domains have been detected | | |
| 4 | 724 | 1035 | LIDVTNAKPSETGIRIPVRIKIK SVKHYCKVVQCLKDYGVQV PAELADELNLRRNKEYCKRA WVWIGTNDVAWVFGSYKIV KFAKVMTRKEYVTWRQSTA LNG (SEQ ID NO: 764) | 103 | No significant similarity found | | | | | | |
| 5 | 1005 | 1823 | VATIHSSEWLDQAKKVPVGQ KRRVYHGAEMTPAMDVWN NEDSWSCYCHRCHAGGKV YKQFLQRVNPEQPVYRKYL NTKDLITIDELYSTDKLKYKRL MKLLHDKGMSMITIAALKPM YNKVDDRLVFRFKGVDIGRD CTGLHGAKWLVYHSDNPSG YVYLQGKNPYCTREPVILCE DLFSAQKVRYYTGWSSLFL MGTNFKDETAHFLMSRLPVI ATDGDAAGWAARKVIRTRC | 272 | putative DNA primase [Pseudomonas phage LKA1] | YP_001522861 .1 | 4e-21 (80/284) | DNA primase | TOPRIM_primases | cd01029 | 6e-04 |

FIG. 23A

| | | | | | | | |
|---|---|---|---|---|---|---|---|
| | | EMFNIPVQSVDVPVGLDPKDM (SEQ ID NO: 765) | | | | | |
| 6 | 1816 | 2130 | MGSKYNRIKFRVSRRSEMLLGIQHAENNGFPVGPDHEWKIERYRGGKALINVRLDYNDTGLNPESWYSTPIGTALWVDTLGDFKHAVNCFCHDGYLDVDNLKVV (SEQ ID NO: 766) | 104 | No significant similarity found | | No putative conserved domains have been detected |
| 7 | 2132 | 2383 | MAIIRIPIRTEAEANQFISIVKSQGLALPDLDVVHRLGLATARVGSDACVWTGIEQYIGTRHDFPHSDETVTVNQLYKRLQER (SEQ ID NO: 767) | 83 | No significant similarity found | | No putative conserved domains have been detected |
| 8 | 2383 | 3690 | MSDLNLLRVMMERKQFTGSFKSIPMDLYDPHTVTMLGWFKLYYKSYEDHERIDVDTLGSLIIKLKTKPHEDKAKRDAQTALMNEMLRNLKQPLPLDIRATTLNALEERRLSAEAAMICRKYDEGEEIDVIFELNKLAIATKQRVELQTHAAWCDTDVWELIQADADDAGYVFDFLPEEFYTNIKGVNEGNNIGVAAPTDKGKTSFLVRVAVSFAKQRFKRMQMDDSMKFRPVYLYLVNEGTAEVITPRVYQTALEIN (SEQ ID NO: 768) | 435 | putative DNA helicase [Pseudomonas phage LKA1] | YP_001522964.1 | 4e-62 (132/408) | DNA helicase | DnaB helicase C terminal domain | cd00984 | 0.003 |

FIG. 23B

| | | | | | | | |
|---|---|---|---|---|---|---|---|
| 9 | 3687 | 4469 | MKFKRGDIVKAVMTGGGCYSI TSGQMYEVLDVRAGGNIMIK PSRGPCNWSKSHRFELVRS KEDTVGVQPTMNIKLYDTVV RTTISHHLKIGEKYTVTTLYP QSNHIAVEGFPNMRFSAADF IVVPDLEDRPKSLGFDKVCA ALKDGTPLQYFNEKWVDV VRPDSISIGMINKSIWRYAINT IDYYGQEIPAPIKQYPSTGLV YGISLTKHEVYKCNVNKRLG QLHYKTAEDAHAVLTTILAPF GITPKALDFSLT (SEQ ID NO: 769) | 260 | No significant similarity found | | | No putative conserved domains have been detected | |
| 10 | 4466 | 5458 | MSLREQVRKYLDVTKSPVQL VKHMDEVLEKNIKYPLIAQHK YDGVYVLVAVTDGIPTLYSR TGKECFEGLYNTDFVMSLN GITDGIYIGELCNSKFSLEVF NGLVSTNRKKSWEDSESQD TIQLLEEIHTFIMFHDYIFHNCL LEGHCKLPYWARYDLLRKRL RVAELLDYLVVSDEVKSRED ADAYAQLIDVGGEGAVFKH PAEEWVAGHKGYRTMKIVR DLVLDLLCVGVEYGKGKREG QIAKLKFSYKGSVF (SEQ ID NO: 770) | 330 | ATP-dependent DNA ligase-like protein [Erwinia amylovora phage Era103] | YP_001039660.1 | 1e-42 (120/320) | ATP-dependent DNA ligase | ATP dependent DNA ligase domain | pfam01 068 | 7e-05 |
| 11 | 5632 | 7956 | MSQINWLVLDFEVGNHDHY GSLASPHHPDNYLVATGWS EDGNSVQAEYHHSKDEQYC KRFADALSRAKNLVAHNLTF ELHWLMKVYFNDLQAFNRG GRFFCTQYAEYILSNQIEMY PNLEDTARKYGGSPKVDAV KLLWEQGVLTADIDQALLMT YLAADGKNEWSNPEDPSFQ GDVANTRRACFAQVAELRK RGMMGMFKERMDSLLFNA WATYNGLYVDLPTAQRNQA EQEKQIAQIKSDILGMLPNDL | 774 | putative DNA polymerase [Pseudomonas phage LKA1] | YP_001522870.1 | 0.0 (383/809) | DNA polymerase | DNA polymerase family A | pfam00 476 | 3e-21 |

FIG. 23C

FIG. 23D

| | | PDD (SEQ ID NO: 771) | | | | | | |
|---|---|---|---|---|---|---|---|---|
| 12 | 8010 / 8912 | MTFNALELVQGIDTSTLADM TDTTTGGGSKRGLLPAGFAF AVFSSYIEYGKQPQMFDGKK KDPALEFRLGFHIVGGVGTN LAGEDEDYVQDGFLPTSTW DTAQSRNEKSKAVKYFNAINI VPKGTHFIQKLGTMYLVEVK VTKNKKTGKDQNEFDFTSLQ QARDQATRKAYTSYTNAAGI EVAMGELKPEDYKVFLVNR PTNVTIEQYQAMWDSIEIKG ETEIKDAAGNVTGKRSKNFL QEKCQRALDFEGSSL (SEQ ID NO: 772) | 300 | hypothetical protein PPLKA1_gp31 [Pseudomonas phage LKA1] | YP_001522872 .1 | 2e-27 (91/261) | hypothetical protein | PHAC020 30 | 4e-30 |
| 13 | 8915 / 9262 | MEDTNRATGRTTRMILKAVE YLIKHPIKTVRIVCYNNYGCV WMADYIKSIVSDRLWQRIEL ATYQHWQCSGIGKRDDYFF DHHCFYHEVYNLNNRLKEVK AGLERAEKDYRKYDA (SEQ ID NO: 773) | 115 | No significant similarity found | | | No putative conserved domains have been detected | | |

| | | | | | | | | |
|---|---|---|---|---|---|---|---|---|
| 14 | 9252 | 10223 | 323 | MMPNLSHFGLDAQTLSDQS TFKPSKGDSNILLYDGDGGC YQSAAGAAKQETAMRRFER DILENMFLAGCTKARVHLTP SGCFKNGRHLLLGAKKYQD NRSNKNKPQHLEYLRSPASV EYFKDHEDIEIILNVRVEADD ALMMDHYRYHNGILVSPDKD LNISPFKSYKAELGKHLVLPE GDRYGWIDREFWLTPSQKP SSKMIGKGTKFFLAQLLMGD TADNVKGILKLNGKLCGESA AFDALNPITDEHEAVNF (SEQ ID NO: 774) | putative DNA exonuclease [Pseudomonas phage LKA1] | YP_001522873 .1 | 8e-56 (136/319) | DNA exonuclea se | 5'-3' exonuclease | cd0000 8 | 4e-04 |
| 15 | 10213 | 10782 | 189 | MNYMETLKRAEFAVQILNAA GYDAHIVGGALRVQALGGTT NDIDIAVITTFKEGELLNKQVN ILLDRLGFNFKLQHQNSDYT DDSDLFIADWCSGDINLIAYN RSVTPTVRDLVNTFDLSINM FYKENGVLKNDVVMLQGVCA VVLNPNRLGHNPKLNERIAR FKQEYDHLDWSPVDKQLAIE EHMNAIL (SEQ ID NO: 775) | poly(A) polymerase [Pseudomonas aeruginosa PAO1] | NP_253415.1 | 0.001 (28/81) | Poly(A) polymeras e | tRNA nucleotidyltransfe rase/poly(A) polymerase | COG06 17 | 8e-05 |
| 16 | 10769 | 11216 | 149 | MPSSRPLQRISRQQLKGIMIA LYQRQGNKCAICGKPIDFSIT GHKANYAVDHNHETGEIRGT LHKSCNSAEGKVTNAAGRW GCKSTDYNDVIPWLESLINYL KTAHRNGTGMMYPDHKTPE QQKDAANLKRKQYAAKKA AERMNASRK (SEQ ID NO: 776) | putative DNA endonuclease [Pseudomonas phage LKA1] | YP_001522874 .1 | 2e-32 (64/110) | DNA endo- nuclease | Endonuclease_7 | pfam02 945 | 2e-10 |
| 17 | 11202 | 11420 | 72 | MQVGSKVVCVYAGDSTLIET HGTYEVLGFSSYDGPNSHV EIGLDGRLLGSYSPKRFMTV EEVTKQTQENLND (SEQ ID NO: 777) | No significant similarity found | | | | | | |

FIG. 23E

| | | | | | | |
|---|---|---|---|---|---|---|
| 18 | 11413 | 12342 | MTKKHHALKGIKLDIMKLWN DGKSYQQIAEVVCKPYDTVY GIVQRYRDQQPPVQHTRKP TIFVIGDTGQKQGIDLAYLHY VGNYILEKRPDIIVHIGDHYD MASLSTYDKGGLSAEGRRV AEDIKAGDKGIEIIENYIARAK DYNPRKVVTLGNHEERIDRP VNHNPEFEGLIGTDKLAFAN YGWEVYPFLTPANICGINFV HFVQNGMTGKPLGGTVMTR LKNVGESFVMGHQQVLDHC LRYLPLSGKAQIGVI (SEQ ID NO: 778) | 309 | hypothetical protein PPLUZ24_gp44 [Pseudomonas phage LUZ24] | YP_001671917 .1 | 6e-43 (96/245) | No putative conserved domains have been detected |
| 19 | 12339 | 12515 | MIIDGTKLRCINDKGQRIVKE GSLYTAWVRDGIGIDGRIFIK EHKRFALLITRFEVVE (SEQ ID NO: 779) | 58 | No significant similarity found | | No putative conserved domains have been detected |
| 20 | 12512 | 13165 | MKIGLIGLAGAGKDTSAVILQ RVLAEQGLKFEIDRYAAPLK NAAKEVFGANFDERNVKEV DVFVDQDTMIEASFRCLRQL GFTDDEDEKASELFFEHIGFL EYLSPRLYQQLLGTEVVRAV RPSAWWDRIRRLNRNIIIPDA RFENEVSDCNLLITRFQNIDK PKIHPSEHLAWDLQFTGKVLP VDTININNEQGTTLELLEERIR SVVSLINFNEVV (SEQ ID NO: 780) | 217 | hypothetical protein Bpse38_326660 [Burkholderia thailandensis MSMB43] | ZP_02468156. 1 | 2e-08 (64/203) | No putative conserved domains have been detected |
| 21 | 13170 | 15699 | MSLYQRQLELEEKYSTMSLV AGQQQILDAFKQGRASDVG SGRILLAKAFAASLEDVKALL DKKITGIGGKYKKLLTLASPD VLVMAVLREVVNGGCASPEPV TMQQFLRSVGRIIESESMLA CMDKVSPEYTSRTVQYLDS AGTKSIQHRYRTFLKGAENIN LHWDQWSSEERTGTAKLILG VIYESTGLFKWKTNPHSASD SMYYLVPSEELEKHFGEVQA | 809 | putative RNA polymerase [Pseudomonas phage LKA1] | YP_001522878 .1 | 1e-102 (271/835) | T3/T7-like RNA polymerase | RNA polymerase | PHA004 52 | 3e-142 |

FIG. 23F

| | | | | | | | |
|---|---|---|---|---|---|---|---|
| | | AARAVVKYPPMLIPPMDWQ GYNEGGYITDWFRMH (SEQ ID NO: 781) | | | | | |
| 22 | 15609 | | | | | | |
| 23 | 15872 | MLLLIITILVVVLAVVIYKSEKE TVRECFGILVEGVTLAKAKS DILKVAKVWFYTLKLTGELIL VPFLTIALILFIIAGATYRAIIK (SEQ ID NO: 782) | 87 | No significant similarity found | | | No putative conserved domains have been detected |
| 23 | 15979 | MSVDKIPNFTEDQIYWLDSIF PENTQLTTNPNEVYVKLGQR QVIQRIKQDTARKRNAYNRA NGG (SEQ ID NO: 783) | 64 | No significant similarity found | | | No putative conserved domains have been detected |
| 24 | 16175 | MGLG3FLKKSIKNSFRGGSL YKLSDKGDNMLRDVFGLNA FKDLAAGQDAQIRAMAEQN KLNTANEIQNVVQFEDDVNT GGSSDQRRRKNSAGAYARA LNLNV (SEQ ID NO: 784) | 102 | No significant similarity found | | | No putative conserved domains have been detected |
| 25 | 16464 | MAGVPELHYSLSSLFHQYRD DGLLDRIETYALWTIPSVFPR DEHTFYNANKNRTIEYDYQSL GALLVNRLASKLARSLFPAN TSFFRIDSDDPRLQQIFKARK LDSVIEYENAACARLFYNAS YAQLVQALRLLIITGECLLYR VNDSMRVYSLKDYVVKRNIN VGEVLDIVICEHKFMEELDPA MKVKVGVVPADTTVKLYTRV QRQLINGTSWKVTQEINGR DVGTNMVYRDKLCPYIPVV WNFVNGDSYGRG (SEQ ID NO: 785) | 521 | putative head-tail connector protein [Pseudomonas phage LKA1] | YP_001522362 .1 | 46-81 (179/480) | head-tail connector protein |

FIG. 23G

| | | | | | | | | |
|---|---|---|---|---|---|---|---|---|
| 26 | 18072 | 18815 | 247 | MSVENLPEGHPAREAAQPT PSVTPAVTPAPTTQPEPQVV YQNIPTYDTDSITDTAVNVFA TSAGIEASRFDAALVNALNY GDEKLIDYTALTQGLKPDQA AQAKALAASVFKDRVAREQA HIQASTQKVYAVAGSAEAWK EASDAFNVSAPDHLKAIVRQ MLDNGDVENAAKFVIETARG TGMVNINGTPIQGGTGAVQ QGLTQEQYYAELAKLERSAG NRGFESGQVGAEFQRLRNA RILGRKQGL (SEQ ID NO: 786) | putative scaffolding protein [Pseudomonas phage LKD16] | YP_001522823.1 | 4e-05 (51/178) | scaffolding protein | scaffolding protein | PHA01929 | 3e-08 |
| 27 | 18857 | 19879 | 340 | MAQGTIYQPNTTRDHWGGA NSDVDQHLEDYTGINDSRFQ YTQIFGALSAQRSVADRSNT VRVDRFNTSKVKGRKAGEAI ESQRVTSDKLNVIVECMMYI RNPIDWMDDWTAPDRLVEM SRNNGTEFAIAYDEAHIIRLQ KARSWVAPDHLKPAFSDGM FVPATLKLTTAGVADLEANA SALVVAHGKIVEALIKRRVPL TDMVTLVTPTVFTELVNHPK LINKDYVESNGDFADRRVVR VNGINVWECTTFPTAP (SEQ ID NO: 787) | capsid protein [Pseudomonas phage LKA1] | YP_001522884.1 | 4e-53 (123/324) | capsid protein | capsid protein | PHA02004 | 2e-62 |
| 28 | 19930 | 20178 | 82 | MPQLCEAIISPALTGQALEVG DRAFEQGNTPAANDRVATL EGQVQALLALLQGQQAAGA PVAPVEWVAEEVKAPAKKAT AEK (SEQ ID NO: 788) | No significant similarity found | | | | | | |
| 29 | 20180 | 20545 | 121 | MGQLDPIDYKQFYRNAGLTEL EETITDLINTLDLKVHSTEAIV HDTTVNTDCNVLVNGRHVV YTDGTGNAPPTAGLYLLEQT YITTEVDQEAIAQTATRYSTG LFYTRIRRSGWWTSWNKVG | No significant similarity found | | | | | No putative conserved domains have been detected | |

FIG. 23H

| | | | | | | | | | |
|---|---|---|---|---|---|---|---|---|---|
| 30 | 20646 | 21203 | 185 | MKLLDAVNAALSYMGEHKIT RVEGSNHPTVDSIVSAINRQ RAALLSTGWMFNELHLTIPV ETDGRIQTPARSLAIYGKSTR VSMEGEHLFNLDTGSYVFTE PVDVRIVRDIDFEDLPEYAAQ YSLYVATAEVYSAELGVDNV VSVLDGLAKDAIANLRQENL RNRRYNPRRNAVRQSRYTW FRNR (SEQ ID NO: 789) | tail tubular protein A [Pseudomonas phage LUZ19] | YP_001671978.1 | 1e-13 (50/148) | tail tubular protein B | | tail tubular protein A | No putative conserved domains have been detected | PHA004 28 | 1e-19 |
| 31 | 21212 | 23506 | 764 | MAVREGTYKSLIQQGVSQQIP QERSDGQLGSQWNMLSDP VTGLRRRAGVKLHARLTNLS SSSYIRMVDILGVYYFMCIDT STGTMKIYTYDGVLKKTYTS EYLKAVSKASIRSTVSRSSC YVVNTDKVPQKVVGATSSTF NPAHGGYFSIRAGAFSKQYT ITVKWGTVTKEFSIMSDGGS ADQVTPAALAQRLWALVGT DPQVTAVFDVVNDGPTVALK AKAGQNPACLSIETGDSSTYI MVSNASRVASRNDLLG (SEQ ID NO: 790) | putative tail tubular protein B [Pseudomonas phage LKA1] | YP_001522886.1 | 7e-87 (238/792) | tail tubular protein B | | | | |
| 32 | 23506 | 24186 | 226 | MAGNFTAGVNTGMQGAQL GANFGPQGAVGGIAGFALG FQTPDYEKIAREKYNSEVLK NFAKSLFDTRKVQNIENMRT AQALAAYQDNLRVQGSSYN AQYGAADMIGSSTTALKQAM DFQTQEAKRGVLINWETQV DNMNTSIDAMANQSMAGLR RTKGDTRQMDYAGLVKTGL DLYGQYRNTFNNPNTSTTQL GINIKIPDNMSDFGSYGKSGS MGGFGGSGSLFG (SEQ ID NO: 791) | No significant similarity found | | | | | | No putative conserved domains have been detected | | |

FIG. 23I

| | | | | | | |
|---|---|---|---|---|---|---|
| 33 | 24201 | MPTMVQSFDLITPTISREQAI DRPVEQDGLSTFLQDVLPKV KEGYDQYQIKENQDHYIALG MNDELNQITRDVSWLDSRN YEQGKEFQKVSSTQEEAQKK AFTDTVTRMAREGKNADEIF DAGREYLTAYTNSVVNSQLS PDLKNALYEAGIKENTYQKLI TKTMSAVAEEREQFDAQTR VAGLYQTVSTGLDDQBNDA LEAHVRKAYAAKIAVGVDPK EAMNAAQNEISATFKFWNG QIDPSSPNASEQVNNVLR (SEQ ID NO: 792) | 955 | No significant similarity found | | No putative conserved domains have been detected |
| 34 | 27084 | MASKYGVGKDIRTLEAVQPD IPENIGTGKGKKLIGTLAADS YKPLGRANTADLLVPEQQLQ DAKAREEASLLETVTAAVAP TARDVWGNAIYESYKFTPDVF YRPDADAQEFFNEYQITNQD EVAYINAANSYEDMEFRKRR ILDRRDDQQKIADNPITGIVA SMFDIDAAAMLVPAVGEVAG AAKFGRIAQRTANASIGAGG AYAINSALEDKSTRTQTERD LDSLTFGLVGFMSPIKYKPKE LDAATTKEMADV (SEQ ID NO: 793) | 1042 | putative internal virion protein [Pseudomonas phage LKA1] | YP_001522889 .1 | 1e-16 (125/511) | internal virion protein | gp37 virion protein | PHA020 06 | 3e-17 |
| 35 | 30214 27068 30212 32605 | MAINQKQSYEYDVSTPQG DFAIGFEDYNEGEKDRINVT VDGDDAASKGYTVLRKNALT IAMTPFVPSGIVRLTRETNID TTFYKFTAGAIFDAANVDANF TQVLHSQQEVRDRQSYVEG RVLPLVTGLEDALAKADEAS KAAQEAAEAAAEAAQCTRS ADKVIDASGLTQQDINNRLAI TYPTAVGLVGKPNLKDADVV YVQSYSNIFDGGDGYYRVSA DTTVADGAYVIRINPNLIAT MLNTTGSVDVARFG (SEQ | 763 | putative tail fiber protein [Pseudomonas phage PT5] | YP_002117764 .1 | 0.066 (35/122) | tail fiber protein | | No putative conserved domains have been detected |

FIG. 23J

| | | | ID NO: 794) | | | | |
|---|---|---|---|---|---|---|---|
| 36 | 32515 | 32880 | MNIVDQIYFGLVYVWSSLDK LIMGAAATAFVVALLRTRKR DGKASWIEATLCGIFATIALV GFSFIAPILVGILAGMGITINLP VDPSAGIAGIVAGFIGWVYGT ERTIEFVEDNLGGDKNG (SEQ ID NO: 795) | 121 | No significant similarity found | | | No putative conserved domains have been detected |
| 37 | 32873 | 33460 | MGKFITLDEITSKAKEYGIET AALRAVMDVECKGHGFNSD GAPVILFERHKFYYGLQAIN WITKSKEWYKLYPDICNPSW GGYGKESQQHERLRRASAL NRDVALESASWGLGQVLGE NVVKDLGYKSLQDFINAMYYK DEVSQLDAMCRFIKHNGLIK HIQSKSWAKFARAYNGPKYA DNKYDTKLAAAYKKFGGI (SEQ ID NO: 796) | 195 | hypothetical protein RPRSA1_gp14 [Ralstonia phage phiRSA1] | YP_001165263 .1 | 4e-38 (85/189) | holin* | No putative conserved domains have been detected |
| | | | | | Putative phage-related protein (hydrolase) [Ralstonia solanacearum GMI 1000] | NP_520052.1 | 2e-37 (85/189) | endolysin | No putative conserved domains have been detected |
| 38 | 33460 | 33816 | MAKRNSAGVSLMNELHAAIA SYMLARLKASIPDPNAPVEY DEETGEEIPAFFIPLAASELQ VMVTFLNNNKITATPDVEHM AALANEFKGDLEAARKERAE SITKVNENDAFMASLLS (SEQ ID NO: 797) | 118 | No significant similarity found | | | | No putative conserved domains have been detected |

FIG. 23K

| | | | | | | |
|---|---|---|---|---|---|---|
| 39 | 33825 | 35777 | MGRVSRIITEQTKRRLAMLLE RCNRYKDNPVAIPAEEREEL SMMFAATFKGFAEFAELGM KYLGFDLSEIQDDIAEYMQY GPAKKMVQAQRGQAKSTLA ALYCIWRLIQNPTARILIVSGG ERQASDVALLIRIIMQWGILC VWMRPDTSKGDRTSASAFDI HYSLKGIDKSASVSCVGITAN LQGMRADFILADDIETQRNS MTQTEREKLLLLTKEFAAICIT GEIMYLGTPQTKDSVYRSLP ARGYDVRVWCG (SEQ ID NO: 797) | 650 | putative DNA maturase B [Pseudomonas phage LKA1] | YP_001522892 .1 | 7e-140 (270/623) | DNA maturase B | No putative conserved domains have been detected |
| 40 | 35774 | 35872 | MSPEEIRRRLDTITERIANAV MIVNLIKEKSK (SEQ ID NO: 799) | 32 | No significant similarity found | | | | |
| 41 | 35869 | 36027 | MSTKREVVVQAVDNAVSVA KAVNANAEYKHKDKVTKGLE LAGNVLQLLKLFK (SEQ ID NO: 800) | 52 | No significant similarity found | | | | |
| 42 | 36038 | 36193 | MDGFESTVKVGVKHTQYEE LRDLKQRGETFDDVIRRLLD AHKSLKSIGLLD (SEQ ID NO: 801) | 51 | No significant similarity found | | | | No putative conserved domains have been detected |
| 43 | 36516 | 36788 | LYSSLSSIYSITLMSIYIYIVIS YCSLFMFFILYSYTCSIQ (SEQ ID NO: 802) | | No significant similarity found | | | | |
| 44 | 37209 | 37427 | MKTLTHIAVQCTCGATGQT GDFLVDIEHFKLTGELIALDG MVFRSLTALYAYANTYGLPT KRLNTPIVYQS (SEQ ID NO: 803) | 72 | No significant similarity found | | | | No putative conserved domains have been detected |

FIG. 23L

| | | | hypothetical protein PPLKD16_gp03 [Pseudomonas phage LKD16] | YP_001527792.1 | 8e-17 (55/144) | PHA01782 hypothetical protein | PHA0 1782 | 8e-25 |
|---|---|---|---|---|---|---|---|---|
| 45 | 37868 | 38386 | MKLLLNVQEINKAIESIANRG KKLDIHDIHVAGVSVLKHVAE HGDTTLLDKLVNAMPKGARK GAFCEWALAFGNVRMLDRS NEADKLAIEQGRLFAKDKTK EYNEVEAMAKAVVYDFKPEP DLLTTFDAAQAVKSLLKYKT ALDNGAEIKGGDVAMQQLK SFMQTLNTMDEQV (SEQ ID NO: 804) | 172 | | | | |
| 46 | 38383 | 38586 | MKVKVRNKFAAATSINYKQH YVVRNGNGTLTLGAEHITEE QAAVLNLQEFSKVREWLGP SYSVEIIV (SEQ ID NO: 805) | 67 | No significant similarity found | No putative conserved domains have been detected | | |
| 47 | 38912 | 39406 | MVTDMTDTKDQGYDLGDEN LLSVAKLAMRRGEYLLSAWD QFAAMDIVDGLNRIPSADGLI VYLKHGLCTNIRFEISPMANH RLRGSQALDSILLELAYPQW DGYSGNSTYPVDGYYEYEG YTEDGEHDAGMYHEPNLFR NPKRKELLTWLVTSFLPEYIK HWSAE (SEQ ID NO: 806) | 164 | No significant similarity found | No putative conserved domains have been detected | | |
| 48 | 39408 | 39915 | MLIVFKVNPNVTVTLNIGLGE SIAWGKYKKENAEHGPVQSL VDILDTPHRVARILERIQGMA YNPNQHHHGPHVAHNSYGI DYGHHVLPNVNWRTVQVGN EMTLVVKFEAVARDIIGQVFY LAEELKQDCIAVWHHNDTNG GIGQLIGRYNYNYWSGGYFNP EYFVHLEV (SEQ ID NO: 807) | 169 | No significant similarity found | No putative conserved domains have been detected | | |
| 49 | 39917 | 40021 | MFKEYNYCGQCRYNYINCH CPTHYPERNKDDHHL (SEQ ID NO: 809) | 34 | No significant similarity found | | | |
| 50 | 40018 | 40101 | MKKLGLIVVYTAAYAAISLVQ WLQDDK (SEQ ID NO: 810) | 27 | No significant similarity found | No putative conserved domains have been detected | | |

FIG. 23M

| | | | | | | | |
|---|---|---|---|---|---|---|---|
| 51 | 40101 | 40870 | MFVLKSTHQKALDEIKSLRA QLDAAAKTKRELQERIDSVR KVRDTVIKYNACLTALCQYLP FGVYRIDYGAERRSCSTLRK TSVVSYSTSVTVDHKAAKMT NRNYTIQHEPLARTCKQAEL TARLVALEVQYNIINRDIVVLD QTIKLAQALYDVPTVCHSVT KRSVLSKQRKRIKHELDLVK VELNNL (SEQ ID NO: 811) | 189 | No significant similarity found | | | No putative conserved domains have been detected |
| 52 | 40720 | 41838 | MKYYDNSHPELQGYKQFIPE NPNQWFDLMSANRAVFIRE DKRVDADVWDMIVQHLTGV SYKPHRYGEGKRHYTEFQLL QGHRKLGEGYCSRVYTHPT NPERVVKFFERYHEDVCCY EYLRMCVQGKLPVFDWLPE VHSLACIKVLIREDDKVRITY GVAVFPRYDPIESDYEKQNR FVQDGINAEFFKKYVHPYLPH ARIDLHWGNIMWDRRLNQY VATDPVIINSAPVETHVQTID WFPKEISAKYSGATACSRP (SEQ ID NO: 812) | 372 | protein kinase [Enterobacteria phage T7] | YP_0419859.1 | 0.16 (47/174) | kinase | protein kinase | PHA0 0451 | 0.002 |
| 53 | 41822 | 42127 | MVVYGNVIFERDLAQTMYKR MSSRLADGVRRCCMVDEHT LYFESEVSDRLSRKKFNMLT GQRIAPYSEIKYPKVGEHTL MSDQAIAEAKAILSSETRTRS (SEQ ID NO: 813) | 101 | No significant similarity found | | | No putative conserved domains have been detected |
| 54 | 42105 | 42308 | VKHVHVVEVIMMLIMSIVVG SYRGVSATTQEFTSKERCM VAAQMALDKKMGGGDNSN RLTAICVPK (SEQ ID NO: 814) | 67 | No significant similarity found | | | No putative conserved domains have been detected |

FIG. 23N

| 55 | 42382 | 42912 | MSLAKQFNAAGIRGSKPKSD KGWTFKAQKAYVRNRFENV ERVIAPVYNHKVEQVARAIIV ETPLASLNVVAQGSSLHYDY SPDTLVRIGKLTRKGATFSA DSNSALAILGLNGAAVLYWL GGLRINIDEQQYEVITNDGEY IYATVGIILQLARDCVFNRDA VLANFQGAKRVRRAK (SEQ ID NO: 815) | 176 | No significant similarity found | No putative conserved domains have been detected |
|---|---|---|---|---|---|---|
| 56 | 42896 | 43015 | VSAPNNIFHKGMRVIVTKAD RDDVRLGLHGDTIATVVGVH (SEQ ID NO: 816) | 39 | No significant similarity found | |

FIG. 23O

| Spot test | Phage | Titer (pfu/ml) | 633/05 | 636/05 | 644/05 | 645/05 | 646/05 | 648/05 | 650/05 | 651/05 | 654/05 | 655/05 | 930/05 | 1194/05 | 1195/05 | 1270/05 | 1305/05 | 1327/05 | 1357/05 | 1362/05 | 1387/05 |
|---|---|---|---|---|---|---|---|---|---|---|---|---|---|---|---|---|---|---|---|---|---|
| | | $1.4 \times 10^{10}$ | +++ | +++ | +++ | +++ | +++ | +++ | +++ | +++ | +++ | +++ | +++ | +++ | +++ | +++ | +++ | +++ | +++ | +++ | +++ |
| | F1245/05 | $1.4 \times 10^{8}$ | +++ | +++ | +++ | +++ | +++ | +++ | +++ | +++ | +++ | +++ | +++ | +++ | +++ | +++ | +++ | +++ | +++ | +++ | +++ |
| | | $1.4 \times 10^{6}$ | +++ | +++ | ++ | ++ | +++ | ++ | +++ | ++ | ++ | ++ | +++ | +++ | +++ | +++ | +++ | ++ | +++ | +++ | +++ |
| | | $1.4 \times 10^{4}$ | + | + | + | + | + | + | + | + | + | + | + | + | + | + | + | + | - | + | + |

FIG. 24A

| 1433/05 | 1514/05 | 1515/05 | 1517/05 | 1632/05 | 2023/05 | 2025/05 | 2083/05 | 2157/05 | 2159/05 | 2160/05 | 130/06 | 140/06 | 441/06 | 658/06 | 681/06 | 887/06 | 986/05 | 398/05 | 609/05 | 611/05 | 652/05 |
|---|---|---|---|---|---|---|---|---|---|---|---|---|---|---|---|---|---|---|---|---|---|
| +++ | +++ | +++ | +++ | +++ | +++ | +++ | +++ | +++ | +++ | +++ | +++ | - | +++ | +++ | +++ | +++ | - | - | - | - | - |
| +++ | +++ | +++ | +++ | +++ | +++ | +++ | +++ | +++* | +++ | +++ | +++ | - | +++ | +++ | +++ | +++ | - | - | - | - | - |
| +++ | ++ | +++ | +++ | +++ | +++ | +++ | - | - | ++ | +++ | - | - | +++ | +++ | +++ | +++ | - | - | - | - | - |
| + | - | + | + | ++ | + | + | - | - | - | + | - | - | + | ++ | + | + | - | - | - | - | - |

FIG. 24B

| ACB strains (n=100) | | | | | | | | | | | | | | | | | | | | | | | | | | | |
|---|---|---|---|---|---|---|---|---|---|---|---|---|---|---|---|---|---|---|---|---|---|---|---|---|---|---|---|
| 653/05 | 1079/05 | 2041/05 | 77/06 | 78/06 | 129/06 | 211/06 | 212/06 | 309/06 | 318/06 | 319/06 | 362/06 | 415/06 | 416/06 | 454/06 | 492/06 | 493/06 | 620/06 | 669/06 | 682/06 | 683/06 | 725/06 | 726/06 |
| - | - | - | +++ | +++ | +++ | + | +++ | +++ | +++ | +++ | +++ | +++ | +++ | +++ | +++ | +++ | - | +++ | +++ | +++ | +++ | +++ |
| - | - | - | +++ | +++ | +++ | - | +++ | +++ | ++ | +++ | +++ | +++ | +++ | ++ | +++ | +++ | - | +++ | +++ | +++ | +++ | +++ |
| - | - | - | - | ++ | ++ | - | + | + | - | - | + | + | + | - | + | +++ | - | ++ | - | + | + | + |

FIG. 24C

| 770/06 | 805/06 | 831/06 | 854/06 | 855/06 | 874/06 | 875/06 | 908/06 | 910/06 | 918/06 | 950/06 | 978/06 | 1018/06 | 1046/06 | 1056/06 | 1210/06 | 1190/05 | 1193/05 | 1268/05 | 1812/05 | 1701/05 | 2084/05 | 1371/05 |
|---|---|---|---|---|---|---|---|---|---|---|---|---|---|---|---|---|---|---|---|---|---|---|
| +++ | - | +++ | +++ | +++ | +++ | +++ | - | +++ | - | - | +++ | ++++ | - | +++ | +++ | +++ | +++ | +++ | +++ | +++ | - | - |
| +++ | - | +++ | +++ | +++ | +++ | +++ | - | +++ | - | - | +++ | ++++ | - | +++ | +++ | +++ | +++ | +++ | +++ | +++ | - | - |
| ++ | - | +++ | +++ | +++ | +++ | +++ | - | +++ | - | - | +++ | +++ | - | +++ | +++ | + | +++ | +++ | +++ | +++ | - | - |
| - | - | ++ | ++ | + | + | + | - | + | - | - | + | ++ | - | + | + |  | ++ | ++ | + | + | - | - |

FIG. 24D

| | 1083/05 | 1127/05 | 692/06 | 538/05 | 1367/05 | 474/06 | 693/06 | 702/06 | 924/06 | 925/06 | 1006/06 | 1006/06 | 1215/06 | Infected strains (%) |
|---|---|---|---|---|---|---|---|---|---|---|---|---|---|---|
| | +++ | +++ | - | - | - | +++ | +++ | - | - | +++ | +++ | - | +++ | 77 |
| | +++ | +++ | - | - | - | ++ | +++ | - | - | - | +++ | - | +++ | 75 |
| | +++ | +++ | - | - | - | - | +++ | - | - | - | +++ | - | ++ | 72 |
| | + | + | - | - | - | - | + | - | - | - | + | - | - | 50 |

FIG. 24E

ANTIBACTERIAL PHAGE, PHAGE PEPTIDES AND METHODS OF USE THEREOF

1. RELATED APPLICATIONS

This International Application claims priority to U.S. Provisional Application Ser. No. 61/150,585, filed Feb. 6, 2009, entitled "Antibacterial Phage and Uses Thereof" and to U.S. Provisional Application Ser. No. 61/218,345, filed Jun. 18, 2009, entitled "Antibacterial Phage, Phage Peptides and Methods of Use Thereof". Where permitted, the subject matter and contents, including sequence listing, of these provisional applications are incorporated by reference herein in their entirety.

SEQUENCE LISTING

The instant application contains a Sequence Listing which has been submitted electronically in ASCII format and is hereby incorporated by reference in its entirety. Said ASCII copy, created on Aug. 19, 2014, is named 16395-105001_SL.txt and is 1,767,167 bytes in size.

2. FIELD OF THE INVENTION

The present invention is directed to the field of phage therapy for the treatment and control of bacterial infections. In particular, the present invention is directed to the novel bacteriophages F1245/05, F168/08, F170/08, F770/05, F197/08, F86/06, F87s/06 and F91a/06, isolated polypeptides thereof, compositions comprising one or more of the novel bacteriophages and/or isolated polypeptides and methods for the treatment and prevention of bacterial infections caused by *Acinetobacter baumannii, Enterococcus faecalis, E. faecium, Pseudomonas aeruginosa*, and/or *Staphylococcus aureus*, either alone or in combination with other antibacterial therapies, e.g., antibiotics or other phage therapies.

3. BACKGROUND

Bacteriophages (phage) are viruses that specifically infect and lyse bacteria. Phage therapy, a method of using whole phage viruses for the treatment of bacterial infectious diseases, was introduced in the 1920s by Felix d'Herelle. Initially, phage therapy was vigorously investigated and numerous studies were undertaken to assess the potential of phage therapy for the treatment of bacterial infection in humans and animals. Early success prompted the development of multiple commercial phage preparations. For example, in 1940 Eli Lilly Company produced 7 phage products for human use, including phage preparations for treating different sicknesses caused by *Staphylococcus* sp., *E. coli* and other pathogenic bacteria. These preparations were used to treat infections that cause abscesses, purulent wounds, vaginitis, acute chronic upper-respiratory tract infections and mastoid infections.

However, with the development of antibiotics in the 1940s, interest in phage-based therapeutics declined in the Western world. One of the most important factors that contributed to this decline was the lack of standardized testing protocols and methods of production. The failure to develop industry wide standards for the testing of phage therapies interfered with the documentation of study results, leading to a perceived lack of efficacy as well as problems of credibility regarding the value of phage therapy. Further, problems related to the production of phage samples/specimens complicated initial study and research. Diverse stabilizers and preservatives were initially used in attempts to increase the viability of the phage therapeutics. However, because the biology of both the phage and the various stabilizers were poorly understood, many of the ingredients added in an attempt to prolong the viability of phage preparations proved to be either toxic to humans or to negatively impact long term storage. Another problem related to phage production was the purity grade of the commercial preparations of these viruses. At the time, phage therapy preparations generally consisted of raw lysates of host bacteria that had been treated with the phage of interest. Thus, many preparations contained what are now recognized as undesired bacterial components, e.g., endotoxins. Accordingly, adverse events were often associated with the preparations, particularly in patients receiving them intravenously. Nevertheless, in Eastern Europe and the former Soviet Union, where access to antibiotics was limited, the development and use of phage therapy continued jointly with, or in place of, antibiotics.

With the rise of antibiotic resistant strains of bacteria, however, interest in phage-based therapeutics has returned in the Western world. Even though novel classes of antibiotics may be developed, the prospect that bacteria will eventually develop resistance to the new drugs has intensified the search for non-chemotherapeutic means for controlling, preventing, and treating bacterial infections. There are three main phage-based strategies for using phage therapy in a clinical environment: 1) the administration of virulent phages; 2) the use of endolysins or purified lysins encoded by bacteriophages 3) the use of structural proteins of the identified phages as metabolic inhibitors of key enzymes for the synthesis of bacterial peptidoglycan.

There is therefore a need to develop novel bacteriophages and phage products as potential therapeutic and prophylactic agents for use in vivo to eliminate pathogenic bacteria. In particular, there is a need for bacteriophages capable of lysing nosocomial bacteria, including *Acinetobacter baumannii, Enterococcus faecalis, E. faecium, Pseudomonas aeruginosa*, and/or *Staphylococcus aureus*. Because most phage and phage peptides studied to date exhibit activity often restricted to the related species, or subspecies, of bacteria from which they are isolated, the novel phage-based therapies may find particular use in the hospital setting, selectively targeting nosocomial pathogens without affecting the normal surrounding flora.

4. SUMMARY OF THE INVENTION

The present invention is directed to isolated bacteriophages and to isolated antibacterial polypeptides of bacteriophage origin for the treatment, prevention, or management of conditions associated with infection by Gram-positive or Gram-negative bacteria. In particular, the isolated bacteriophage or polypeptides of the invention may be used in pharmaceutical compositions for the treatment, prophylaxis, or management of infection by nosocomial pathogens, e.g., Gram-positive bacteria including but not limited to *Enterococcus faecalis, E. faecium, E. hirae, E. avium, Staphylococcus aureus, S. epidermidis, S. auricularis, S. capitis, S. haemolyticus, S. hominis, S. saprophyticus, S. simulans*, and *S. xylosis*; and/or Gram-negative bacteria including but not limited to *Acinetobacter baumannii*, and *Pseudomonas aeruginosa*. In certain embodiments, the pharmaceutical compositions of the invention are of use in the treatment of conditions associated with infection by antibiotic resistant strains of bacteria, e.g., methicillin resistant strains of *Staphylococcus aureus* (MRSA). In particular embodiments, the isolated bacteriophages or polypeptides of the invention are used for the topical treatment of infection by nosocomial pathogens in a subject in need thereof. In other embodiments, the isolated bacteriophages or polypeptides of the invention are used for the diagnosis of the infective agent in a sample (e.g., tissue, blood, urine, sputum sample) derived from a patient. In other embodiments, the isolated bacteriophages or polypeptides of the invention are used as a prophylactic disinfectant or anti-infective for the preparation of solid surfaces, including skin or other epidermal surfaces.

In certain embodiments, the invention provides an isolated bacteriophage, F168/08 or F170/08, having a genome comprising the nucleic acid sequence of SEQ ID NO:1 or SEQ ID NO:2, respectively, and exhibiting antibacterial activity against one or more strains of *Enterococcus faecalis* and/or *E. faecium*. In other embodiments, the invention provides an isolated bacteriophage, F770/05, having a genome comprising the nucleic acid sequence of SEQ ID NO:3 and exhibiting antibacterial activity against one or more strains of *Pseudomonas aeruginosa*. In yet other embodiments, the invention provides the isolated bacteriophage F197/08, F86/06, F87s/06 or F91a/06 having a genome comprising the nucleic acid sequence of SEQ ID NO:4, SEQ ID NO:5, SEQ ID NO:6 or SEQ ID NO:7, respectively, and exhibiting antibacterial activity against one or more strains of *Staphylococcus aureus*. In still yet other embodiments, the invention provides an isolated bacteriophage, F1245/05, having a genome comprising the nucleic acid sequence of SEQ ID NO:760 and exhibiting antibacterial activity against one or more strains of *Acinetobacter baumannii*.

The invention also encompasses isolated bacteria infected with one or more bacteriophage of the invention. In specific embodiments, the invention provides an isolated *E. faecalis* infected with a bacteriophage having a genome comprising or consisting of the nucleic acid sequence of SEQ ID NO:1 and/or SEQ ID NO:2. In other embodiments, the invention provides an isolated *E. faecium* infected with a bacteriophage having a genome comprising or consisting of the nucleic acid sequence of SEQ ID NO:1 and/or SEQ ID NO:2. In still other embodiments, the invention provides an isolated *P. aeruginosa* infected with a bacteriophage having a genome comprising or consisting of the nucleic acid sequence of SEQ ID NO:3. In yet other embodiments, the invention provides an isolated *S. aureus* infected with one or more bacteriophages having a genome comprising or consisting of the nucleic acid sequence of SEQ ID NO:4, SEQ ID NO:5, SEQ ID NO:6 and/or SEQ ID NO:7. In still yet other embodiments, the invention provides an isolated *A. baumannii* infected with a bacteriophage having a genome comprising or consisting of the nucleic acid sequence of SEQ ID NO:760.

The present invention encompasses polypeptides isolated from bacteriophage F1245/05, F168/08, F170/08, F770/05, F197/08, F86/06, F87s/06 and/or F91a/06, which polypeptides exhibit antibacterial activity against one or more species or strains of Gram-positive or Gram-negative bacterium, e.g., *A. baumannii, E. faecalis, E. faecium, P. aeruginosa* and/or *S. aureus*. In specific embodiments, the polypeptides of the invention isolated or derived from F168/08 or F/170/08 exhibit antibacterial or antimicrobial activity, e.g., lytic killing activity, against at least *E. faecalis* and/or *E. faecium*; those isolated or derived from F770/05 against at least *P. aeruginosa*; those isolated or derived from F197/08, F86/06, F87s/06 or F91a/06 against at least *S. aureus*; and those isolated or derived from F1245/05 against at least *A. baumannii*.

In certain embodiments, a polypeptide of the invention comprises or consists of an isolated endolysin or fragment thereof (e.g., a CHAP domain) that exhibits antibacterial activity against one or more species or strains of bacteria, e.g., Gram-positive bacteria and/or Gram-negative bacteria such as *A. baumannii, E. faecalis, E. faecium, P. aeruginosa* and/or *S. aureus*. In specific embodiments, the polypeptide of the invention is an isolated lysin protein, e.g., an endolysin or tail lysin, comprising or consisting of the amino acid sequence SEQ ID NO:68, SEQ ID NO:184, SEQ ID NO:202, SEQ ID NO:203, SEQ ID NO:446, SEQ ID NO:447, SEQ ID NO:448, SEQ ID NO:575, SEQ ID NO:641 or SEQ ID NO:712. In yet still other embodiments, the invention provides a polypeptide comprising or consisting of an amino acid sequence selected from the group consisting of SEQ ID NO: 761 to SEQ ID NO: 816.

In other embodiments, a polypeptide of the invention comprises a fragment, variant or derivative of SEQ ID NO:68, SEQ ID NO:184, SEQ ID NO:202, SEQ ID NO:203, SEQ ID NO:446, SEQ ID NO:447, SEQ ID NO:448, SEQ ID NO:575, SEQ ID NO:641 or SEQ ID NO:712, wherein said fragment, variant or derivative has antibacterial activity or antimicrobial activity, e.g., lytic killing activity, against one or more strains of *E. faecalis, E. faecium, P. aeruginosa* and/or *S. aureus*. In specific examples in accordance with this embodiment, the variant, fragment or derivative of the amino acid sequence of SEQ ID NO:68, SEQ ID NO:184, SEQ ID NO:202 and/or SEQ ID NO:203 exhibits antibacterial or antimicrobial activity (e.g., lytic killing activity) against one or more strains of *E. faecalis* and/or *E. faecium*. In other examples in accordance with this embodiment, the variant, fragment or derivative of the amino acid sequence of SEQ ID NO:446, SEQ ID NO:447, SEQ ID NO:448, SEQ ID NO:575, SEQ ID NO:641 and/or SEQ ID NO:712 exhibits antibacterial or antimicrobial activity (e.g., lytic killing activity) against one or more strains of *S. aureus*.

In specific embodiments, the isolated polypeptide of the invention comprises or consists of the CHAP domain of SEQ ID NO:68, SEQ ID NO:446, SEQ ID NO:575, SEQ ID NO:641 or SEQ ID NO:712. In certain embodiments, the isolated polypeptide comprises or consists of the CHAP domain of SEQ ID NO:68, SEQ ID NO:446, SEQ ID NO:575, SEQ ID NO:641 or SEQ ID NO:712, e.g., having the amino acid sequence of SEQ ID NO:755, SEQ ID NO:756, SEQ ID NO:757, SEQ ID NO:758 or SEQ ID NO:759, respectively. In other embodiments, a polypeptide of the invention comprises a fragment, variant or derivative of SEQ ID NO:755, SEQ ID NO:756, SEQ ID NO:757, SEQ ID NO:758 or SEQ ID NO:759, wherein said fragment, variant or derivative has antibacterial activity or antimicrobial activity, e.g., lytic killing activity, against at least one or more strains of *E. faecalis, E. faecium, P. aeruginosa* and/or *S. aureus*. In yet still other embodiments, a polypeptide of the invention comprises a fragment, variant or derivative of SEQ ID NO: 761 to SEQ ID NO: 816, wherein said fragment, variant or derivative has antibacterial activity or antimicrobial activity, e.g., lytic killing activity, against at least one or more strains of *A. baumannii*.

In other embodiments, a polypeptide of the invention comprises or consists of an isolated tail length tape measure protein or tail protein (e.g., tail component, tail fiber protein, adsorption associated tail protein), or fragment thereof, having a biologic function associated with the bacteriophage from which it is derived, e.g., antimicrobial or antibacterial activity (e.g., lytic killing activity), which function is directed against at least one or more species or strains of *E. faecalis, E. faecium, P. aeruginosa, S. aureus*, and/or *A. baumannii*. In specific embodiments, the polypeptide of the invention is an isolated tail length tape measure protein or tail proteins comprising or consisting of the amino acid sequence SEQ ID NO:61, SEQ ID NO:63, SEQ ID NO:204, SEQ ID NO:214, SEQ ID NO:435, SEQ ID NO:438, SEQ ID NO:440, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:567, SEQ ID NO:568, SEQ ID NO:632, SEQ ID NO:633, SEQ ID NO:700, SEQ ID NO:701, SEQ ID NO:702, SEQ ID NO:703, SEQ ID NO:704 or SEQ ID NO:795. In other embodiments, a polypeptide of the invention comprises a fragment, variant or derivative of SEQ ID NO:61, SEQ ID NO:63, SEQ ID NO:204, SEQ ID NO:214, SEQ ID NO:435, SEQ ID NO:438, SEQ ID NO:440, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:567, SEQ ID NO:568, SEQ ID NO:632, SEQ ID NO:633, SEQ ID NO:700, SEQ ID NO:701, SEQ ID NO:702, SEQ ID NO:703, SEQ ID NO:704 or SEQ ID NO:795, wherein said fragment, variant or derivative exhibits a biologic function associated with the bacteriophage from which it is derived, e.g., antimicrobial or antibacterial activity (e.g., lytic killing activity), which function is directed against one or more strains of *E. faecalis*, *E. faecium*, *P. aeruginosa*, *S. aureus*, and/or *A. baumannii*.

In certain embodiments, the invention encompasses a variant, fragment or derivative of the amino acid sequence of SEQ ID NO:61 or SEQ ID NO:63 that exhibits a biologic function associated with the bacteriophage having a genome comprising or consisting of the nucleic acid sequence SEQ ID N0:1, e.g., antimicrobial or antibacterial activity (e.g., lytic killing activity), which function is directed against one or more strains of *E. faecalis* and/or *E. faecium*. In other embodiments, the invention encompasses a variant, fragment or derivative of the amino acid sequence of SEQ ID NO:204 or SEQ ID NO:214 that exhibits a biologic function associated with the bacteriophage having a genome comprising or consisting of the nucleic acid sequence SEQ ID NO:2, e.g., antimicrobial or antibacterial activity (e.g., lytic killing activity), which function is directed against one or more strains of *E. faecalis* and/or *E. faecium*.

In certain embodiments, the invention encompasses a variant, fragment or derivative of the amino acid sequence of SEQ ID NO:435 or SEQ ID NO:438 that exhibits a biologic function associated with the bacteriophage having a genome comprising or consisting of the nucleic acid sequence SEQ ID NO:3, e.g., antimicrobial or antibacterial activity (e.g., lytic killing activity), which function is directed against one or more strains of *P. aeruginosa*.

In certain embodiments, the invention encompasses a variant, fragment or derivative of the amino acid sequence of SEQ ID NO:440, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538 or SEQ ID NO:539 that exhibits a biologic function associated with the bacteriophage having a genome comprising or consisting of the nucleic acid sequence SEQ ID NO:4, e.g., antimicrobial or antibacterial activity (e.g., lytic killing activity), which function is directed against one or more strains of *S. aureus*. In other embodiments, the invention encompasses a variant, fragment or derivative of the amino acid sequence of SEQ ID NO:567 or SEQ ID NO:568 that exhibits a biologic function associated with the bacteriophage having a genome comprising or consisting of the nucleic acid sequence SEQ ID NO:5, e.g., antimicrobial or antibacterial activity (e.g., lytic killing activity), which function is directed against one or more strains of *S. aureus*. In yet other embodiments, the invention encompasses a variant, fragment or derivative of the amino acid sequence of SEQ ID NO:632 or SEQ ID NO:633 that exhibits a biologic function associated with the bacteriophage having a genome comprising or consisting of the nucleic acid sequence SEQ ID NO:6, e.g., antimicrobial or antibacterial activity (e.g., lytic killing activity), which function is directed against one or more strains of *S. aureus*. In yet other embodiments, the invention encompasses a variant, fragment or derivative of the amino acid sequence of SEQ ID NO:700, SEQ ID NO:701, SEQ ID NO:702, SEQ ID NO:703 or SEQ ID NO:704 that exhibits a biologic function associated with the bacteriophage having a genome comprising or consisting of the nucleic acid sequence SEQ ID NO:7, e.g., antimicrobial or antibacterial activity (e.g., lytic killing activity), which function is directed against one or more strains of *S. aureus*.

In certain embodiments, the invention encompasses a variant, fragment or derivative of the amino acid sequence of SEQ ID NOS: 761-816 that exhibits a biologic function associated with the bacteriophage having a genome comprising or consisting of the nucleic acid sequence SEQ ID NO:760, e.g., antimicrobial or antibacterial activity (e.g., lytic killing activity), which function is directed against one or more strains of *A. baumannii*.

In certain embodiments, the invention provides for isolated polypeptides that exhibit antimicrobial or antibacterial activity (e.g., lytic killing activity) against one or more strains of bacteria (e.g., Gram-positive bacteria (e.g., *E. faecalis*, *E. faecium*, *S. aureus*), Gram-negative bacteria (e.g., of *A. baumannii*, *P. aeruginosa*) or bacteria not classified as either Gram-positive or Gram-negative), wherein the isolated polypeptides have an amino acid sequence with at least 60%, 65%, 70%, 75%, 80%, 85%, 86%, 87%, 88%, 89%, 90%, 91%, 92%, 93%, 94%, 95%, 96%, 97%, 98%, 99%, or greater sequence identity to a second amino acid sequence of the same length (i.e., consisting of the same number of residues), which second amino acid sequence is SEQ ID NO:61, SEQ ID NO:63, SEQ ID NO:68, SEQ ID NO:184, SEQ ID NO:202, SEQ ID NO:203, SEQ ID NO:204, SEQ ID NO:214, SEQ ID NO:435, SEQ ID NO:438, SEQ ID NO:440, SEQ ID NO:446, SEQ ID NO:447, SEQ ID NO:448, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:567, SEQ ID NO:568, SEQ ID NO:575, SEQ ID NO:632, SEQ ID NO:633, SEQ ID NO:641, SEQ ID NO:700, SEQ ID NO:701, SEQ ID NO:702, SEQ ID NO:703, SEQ ID NO:704, SEQ ID NO:712, SEQ ID NO:755, SEQ ID NO:756, SEQ ID NO:757, SEQ ID NO:758, SEQ ID NO:759, SEQ ID NOS: 761-816, and/or a fragment thereof.

The invention further provides isolated polypeptides comprising or consisting of the amino acid sequence of any of SEQ ID NOS:8-130, SEQ ID NOS:131-343, SEQ ID NOS:344-438, SEQ ID NOS:439-553, SEQ ID NOS:554-616, SEQ ID NOS:617-681, SEQ ID NOS:682-759, and SEQ ID NOS:761-816. In other embodiments, isolated polypeptides of the invention recombinantly fused or chemically conjugated (e.g., covalent or non-covalent conjugation) to therapeutic agents (e.g., heterologous polypeptides or small molecules) are provided.

The invention also encompasses polynucleotides that encode the polypeptides of the invention. In a specific embodiment, the invention provides an isolated nucleic acid comprising a nucleic acid sequence encoding the polypeptide of any of SEQ ID NOS:8-130, SEQ ID NOS:131-343, SEQ ID NOS:344-438, SEQ ID NOS:439-553, SEQ ID NOS:554-616, SEQ ID NOS:617-681, SEQ ID NOS:682-759, and SEQ ID NOS 761-816. In other embodiments, the invention provides an isolated nucleic acid comprising a nucleic acid sequence encoding the polypeptide of any of SEQ ID NO:61, SEQ ID NO:63, SEQ ID NO:68, SEQ ID NO:184, SEQ ID NO:202, SEQ ID NO:203, SEQ ID NO:204, SEQ ID NO:214, SEQ ID NO:435, SEQ ID NO:438, SEQ ID NO:440, SEQ ID NO:446, SEQ ID NO:447, SEQ ID NO:448, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:567, SEQ ID NO:568, SEQ ID NO:575, SEQ ID NO:632, SEQ ID NO:633, SEQ ID NO:641, SEQ ID NO:700, SEQ ID NO:701, SEQ ID NO:702, SEQ ID NO:703, SEQ ID NO:704, SEQ ID NO:712, SEQ ID NO:755, SEQ ID NO:756, SEQ ID NO:757, SEQ ID NO:758, SEQ ID NO:759, SEQ ID NOS 761-816, or active fragment, variant or derivative thereof, which polypeptide or active fragment, variant or derivative exhibits a biologic function associated with the bacteriophage from which it is isolated and/or derived, e.g., antimicrobial or antibacterial activity (e.g., lytic killing activity). The invention also relates to a vector comprising said nucleic acid. In one specific embodiment, said vector is an expression vector. The invention further provides host cells containing a vector comprising polynucleotides encoding the polypeptides of the invention.

The present invention encompasses methods for the production of polypeptides of the invention or active fragments thereof, in particular for use in pharmaceutical compositions, i.e., antimicrobial compositions. For example, the polypeptides of the invention may be isolated directly from cell cultures (e.g., bacterial cell cultures) infected with bacteriophage F1245/05, F168/08, F170/08, F770/05, F197/08, F86/06, F87s/06 or F91a/06. Alternatively, the polypeptides of the present invention may be derived by recombinant means using expression vectors comprising nucleic acid sequence encoding polypeptides of the invention, e.g., SEQ ID NO:61, SEQ ID NO:63, SEQ ID NO:68, SEQ ID NO:184, SEQ ID NO:202, SEQ ID NO:203, SEQ ID NO:204, SEQ ID NO:214, SEQ ID NO:435, SEQ ID NO:438, SEQ ID NO:440, SEQ ID NO:446, SEQ ID NO:447, SEQ ID NO:448, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:567, SEQ ID NO:568, SEQ ID NO:575, SEQ ID NO:632, SEQ ID NO:633, SEQ ID NO:641, SEQ ID NO:700, SEQ ID NO:701, SEQ ID NO:702, SEQ ID NO:703, SEQ ID NO:704, SEQ ID NO:712, SEQ ID NO:755, SEQ ID NO:756, SEQ ID NO:757, SEQ ID NO:758, SEQ ID NO:759, SEQ ID NOS: 761-816, or active fragments, derivatives or variants thereof. The polypeptides of the invention or fragments thereof can be produced by any method known in the art for the production of a polypeptide, in particular, by chemical synthesis or by recombinant expression techniques. In specific embodiments, the invention relates to a method for recombinantly producing a phage protein, e.g., a lysin protein, tail protein or active fragment, variant or derivative thereof, said method comprising: (i) culturing under conditions suitable for the expression of said protein in a medium, a host cell containing a vector comprising a nucleic acid sequence encoding the amino acid sequence SEQ ID NO:61, SEQ ID NO:63, SEQ ID NO:68, SEQ ID NO:184, SEQ ID NO:202, SEQ ID NO:203, SEQ ID NO:204, SEQ ID NO:214, SEQ ID NO:435, SEQ ID NO:438, SEQ ID NO:440, SEQ ID NO:446, SEQ ID NO:447, SEQ ID NO:448, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:567, SEQ ID NO:568, SEQ ID NO:575, SEQ ID NO:632, SEQ ID NO:633, SEQ ID NO:641, SEQ ID NO:700, SEQ ID NO:701, SEQ ID NO:702, SEQ ID NO:703, SEQ ID NO:704, SEQ ID NO:712, SEQ ID NO:755, SEQ ID NO:756, SEQ ID NO:757, SEQ ID NO:758, SEQ ID NO:759, SEQ ID NOS:761-816, or fragment thereof; and (ii) recovery of said protein from said medium. In certain embodiments, the nucleic acid sequence encoding the polypeptide of the invention is operably linked to a heterologous promoter.

The invention also encompasses methods for the diagnosis of the causative agent in a clinical presentation of bacterial infection. The isolated bacteriophages or polypeptides of the invention may be used to aid in the determination of species of bacteria in a patient sample by establishing susceptibility of the bacteria in the sample to the bacteriophages and/or polypeptides of the invention. Such methods further encompass methods of evaluation of antibacterial activity of the isolated bacteriophages and/or polypeptides of the invention. Antibacterial activity of the bacteriophages or the polypeptides of the invention, or susceptibility of an unknown sample to such activity, may be assessed by any method known in the art and/or described herein. In certain embodiments, antibacterial activity and/or susceptibility is assessed by culturing known bacteria and/or patient tissue, blood, fluid or swab samples according to standard techniques (e.g., in liquid culture or on agar plates), contacting the culture with bacteriophages and/or polypeptides of the invention and monitoring cell growth after said contacting. For example, in a liquid culture, the bacteria (e.g., A. baumannii, E. faecalis, E. faecium, P. aeruginosa, S. aureus) may be grown to a optical density ("OD") representative of a mid-point in exponential growth of the culture; the culture is exposed to one or more concentrations of one or more bacteriophages and/or polypeptides of the invention and the OD is monitored relative to a control culture. Decreased OD relative to a control culture is representative of a bacteriophage and/or polypeptide exhibiting antibacterial activity (e.g., exhibits lytic killing activity) against the tested sample or bacterial species and/or strain in the culture. Similarly, bacterial colonies can be allowed to form on an agar plate, the plate exposed to a bacteriophage or polypeptide of the invention, and subsequent growth of the colonies evaluated relative to control plates. Decreased size of colonies, or decreased total numbers of colonies, indicates a bacteriophage and/or polypeptide with antibacterial activity against the tested sample and/or cultured species or strain.

The present invention is also directed to pharmaceutical compositions comprising or consisting of a bacteriophage having a genome comprising or consisting of the nucleic acid sequence SEQ ID NO:1, SEQ ID NO:2, SEQ ID NO:3, SEQ ID NO:4, SEQ ID NO:5, SEQ ID NO:6 or SEQ ID NO:7, or SEQ ID NO:760. In certain embodiments, the pharmaceutical composition of the invention comprises a bacteriophage having the genome comprising or consisting of the nucleic acid sequence SEQ ID NO:1, SEQ ID NO:2, SEQ ID NO:3, SEQ ID NO:4, SEQ ID NO:5, SEQ ID NO:6 or SEQ ID NO:7, or SEQ ID NO:760 in addition to one or more other bacteriophages. The one or more other bacteriophages may be one or more bacteriophages of the invention (e.g., having a genome comprising or consisting of a nucleic acid sequence of SEQ ID NO:1, SEQ ID NO:2, SEQ ID NO:3, SEQ ID NO:4, SEQ ID NO:5, SEQ ID NO:6 or SEQ ID NO:7, or SEQ ID NO:760), one or more strains thereof, or may be one or more bacteriophages known in the art. Further, the one or more bacteriophages in the pharmaceutical composition of the invention may target the same or different species or strains of bacteria. In certain embodiments, the pharmaceutical compositions comprising one or more bacteriophages of the invention further comprise one or more polypeptides of the invention and/or other phage products as described herein or known in the art.

In certain embodiments, the invention provides pharmaceutical compositions comprising polypeptides, or active fragments thereof, in particular those having anti-microbial and/or antibacterial activity, isolated from bacteriophage having a genome comprising or consisting of the nucleic acid sequence SEQ ID NO:1, SEQ ID NO:2, SEQ ID NO:3, SEQ ID NO:4, SEQ ID NO:5, SEQ ID NO:6 SEQ ID NO:7, and/or SEQ ID NO:760. In specific embodiments, the pharmaceutical compositions of the invention comprise one or more polypeptides having an amino acid sequence of SEQ ID NO:61, SEQ ID NO:63, SEQ ID NO:68, SEQ ID NO:184, SEQ ID NO:202, SEQ ID NO:203, SEQ ID NO:204, SEQ ID NO:214, SEQ ID NO:435, SEQ ID NO:438, SEQ ID NO:440, SEQ ID NO:446, SEQ ID NO:447, SEQ ID NO:448, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:567, SEQ ID NO:568, SEQ ID NO:575, SEQ ID NO:632, SEQ ID NO:633, SEQ ID NO:641, SEQ ID NO:700, SEQ ID NO:701, SEQ ID NO:702, SEQ ID NO:703, SEQ ID NO:704, SEQ ID NO:712, SEQ ID NO:755, SEQ ID NO:756, SEQ ID NO:757, SEQ ID NO:758, SEQ ID NO:759 or SEQ ID NOS:761-816. In other embodiments, the pharmaceutical compositions of the invention comprise a polypeptide that is a variant, derivative or fragment of SEQ ID NO:61, SEQ ID NO:63, SEQ ID NO:68, SEQ ID NO:184, SEQ ID NO:202, SEQ ID NO:203, SEQ ID NO:204, SEQ ID NO:214, SEQ ID NO:435, SEQ ID NO:438, SEQ ID NO:440, SEQ ID NO:446, SEQ ID NO:447, SEQ ID NO:448, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:567, SEQ ID NO:568, SEQ ID NO:575, SEQ ID NO:632, SEQ ID NO:633, SEQ ID NO:641, SEQ ID NO:700, SEQ ID NO:701, SEQ ID NO:702, SEQ ID NO:703, SEQ ID NO:704, SEQ ID NO:712, SEQ ID NO:755, SEQ ID NO:756, SEQ ID NO:757, SEQ ID NO:758, SEQ ID NO:759, or SEQ ID NOS:761-816 wherein the variant, derivative or fragment retains a biologic function of the polypeptide from which it is derived, e.g., antimicrobial or antibacterial activity (e.g., lytic killing activity), preferably against one or more strains of *A. baumannii, E. faecalis, E. faecium, P. aeruginosa* and/or *S. aureus*.

The pharmaceutical compositions of the invention may additionally comprise a pharmaceutically acceptable carrier, excipient, or stabilizer. In certain embodiments, the pharmaceutical compositions of the invention are antibiotic compositions (in that they exhibit antibacterial activity) or therapeutic compositions for the treatment, prevention, and/or amelioration of symptoms of a disease or disorder associated with infection by bacteria in a subject in need thereof. In specific embodiments, the pharmaceutical compositions of the invention are antibacterial compositions or therapeutic compositions for the treatment, prevention, and/or amelioration of symptoms of a disease or disorder associated with infection by *A. baumannii, E. faecalis, E. faecium, P. aeruginosa* and/or *S. aureus*. In certain embodiments, the subject receiving a pharmaceutical composition of the invention is a mammal (e.g., bovine, ovine, caprine, equid, primate (e.g., human), rodent, lagomorph or avian (e.g., chicken, duck, goose)).

The present invention provides for methods for the treatment or prevention of bacterial infection comprising administering to a subject in need thereof a pharmaceutical composition comprising one or more bacteriophages or phage products (e.g., an isolated bacteriophage polypeptide or active fragment, variant or derivative thereof), optionally in addition to one or more other bacteriophages or other phage products, as described herein. In the context of the present invention, "treatment" refers to both therapeutic treatment and prophylactic or preventative measures, wherein the object is to eliminate, lessen, decrease the severity of, slow the progression of or delay or prevent the symptoms or underlying cause (e.g., bacterial infection) associated with the pathological condition or disorder. The pharmaceutical compositions of the present invention may be used in the treatment or management of infections associated with any bacterial infection, including, but not limited to *A. baumanni, S. aureus, S. epidermidis, S. auricularis, S. capitis, S. haemolyticus, S. hominis, S. saprophyticus, S. simulans, S. xylosis, M. luteus, B. subtilis, B. pumilus, E. faecalis, E. hirae, E. faecium, E. avium, P. aeruginosa* and combinations thereof. In certain embodiments, the pharmaceutical compositions may be used to treat conditions or disorders associated with bacterial infections including, but not limited to, post-operative endophtalmitis, endocarditis, infections of the central nervous system, pneumonia, osteomylelitis, wound infections (e.g., diabetic foot ulcers), mastitis, septicemia, food poisoning and meningitis and/or other conditions associated with nosocomial bacterial infections.

In certain embodiments, the invention provides for the use of a bacteriophage or an isolated phage product (e.g., an isolated phage polypeptide or active fragment, variant or derivative thereof) as a single agent therapy. In other embodiments, the invention provides for the use of a bacteriophage, or phage product (e.g., an isolated phage polypeptide or active fragment, variant or derivative thereof), in combination with a standard or experimental treatment for bacterial infection. Such combination therapy may enhance the efficacy of the standard or experimental treatment. Examples of therapeutic agents that are particularly useful in combination with a polypeptide of the invention are anti-inflammatory agents, standard chemotherapeutic antibiotic agents (e.g., penicillin, synthetic penicillins, bacitracin, methicillin, cephalosporin, polymyxin, cefaclor, Cefadroxil, cefamandole nafate, cefazolin, cefixime, cefmetazole, cefonioid, cefoperazone, cefo-ranide, cefotanme, cefotaxime, cefotetan, cefoxitin, cefpodoxime proxetil, ceftazidime, ceftizoxime, ceftriaxone, cefriaxone moxalactam, cefuroxime, cephalexin, cephalosporin C, cephalosporin C sodium salt, cephalothin, cephalothin sodium salt, cephapirin, cephradine, cefuroximeaxetil, dihydratecephalothin, moxalactam, loracarbef mafate and chelating agents), local anesthetic agents, and/or corticosteroids. In yet another embodiment, the compositions of the present invention may be combined with one or more bacteriophages or phage products known in the art. The combination therapies encompassed by the invention may be formulated into a single pharmaceutical composition or may be administered in separate compositions, but as part of an overall treatment regimen.

The pharmaceutical compositions of the invention may be administered by any method known in the art suitable for administration of an antibacterial compound (e.g., via oral or parenteral (e.g., inhalation, intramuscular, intravenous, or epidermal)) delivery. In preferred embodiments, the pharmaceutical compositions of the invention are administered topically, e.g., in a topical formulation. The compositions of the invention may be used topically to treat and/or prevent common nosocomial infections, such as infections at surgical incision sites or associated with catheters or drains. In other embodiments, the compositions of the invention are use to treat bacterial infections of the skin or upper dermal layers (e.g., infections of diabetic ulcers of the foot).

The pharmaceutical compositions of the present invention may also be used for traditionally non-therapeutic uses such as antibacterial agents in cosmetics, or in sprays or solutions for use on solid surfaces to prevent the colonization of bacteria (i.e., as disinfectants).

The present invention is also directed to methods for screening peptides for antibacterial activity. In one embodiment the method comprises screening contiguous amino acid sequences of at least 6, 10, 15, 20 or 25 residues in length that are encoded by the open reading frames of the nucleic acid sequence SEQ ID NO:1, SEQ ID NO:2, SEQ ID NO:3, SEQ ID NO:4, SEQ ID NO:5, SEQ ID NO:6, SEQ ID NO:7, or SEQ ID NO:760 for antibacterial activity, said antibacterial activity measured by the peptides ability to inhibit bacterial growth in agar or liquid culture.

4.1 DEFINITIONS

As used herein, the term "fragment" refers to a peptide or polypeptide comprising an amino acid sequence of at least 5 contiguous amino acid residues, at least 10 contiguous amino acid residues, at least 15 contiguous amino acid residues, at least 20 contiguous amino acid residues, at least 25 contiguous amino acid residues, at least 40 contiguous amino acid residues, at least 50 contiguous amino acid residues, at least 60 contiguous amino residues, at least 70 contiguous amino acid residues, at least contiguous 80 amino acid residues, at least contiguous 90 amino acid residues, at least contiguous 100 amino acid residues, at least contiguous 125 amino acid residues, at least 150 contiguous amino acid residues, at least contiguous 175 amino acid residues, at least contiguous 200 amino acid residues, or at least contiguous 250 amino acid residues of the amino acid sequence of a protein. In a specific embodiment, the fragment is a functional fragment in that it retains at least one function of the protein from which it is isolated (e.g., antimicrobial or antibacterial activity (e.g., lytic cell killing)).

As used herein the terms "active bacteriophage products" and "bacteriophage products" refer to polypeptides, or fragments, variants or derivatives thereof, isolated from a bacteriophage of the invention, which polypeptide, or fragment, variant or derivative thereof, exhibits a biological function or activity associated with the bacteriophage from which it was isolated or derived (e.g., antimicrobial or antibacterial activity (e.g., lytic cell killing)).

As used herein, the term "isolated" in the context of a peptide, polypeptide, or fusion protein or refers to a peptide, polypeptide or fusion protein that is substantially free of cellular material or contaminating proteins from the cell or tissue source from which it is derived, or substantially free of chemical precursors or other chemicals when chemically synthesized. The language "substantially free of cellular material" includes preparations of a peptide, polypeptide or fusion protein in which the peptide, polypeptide or fusion protein is separated from cellular components of the cells from which it is isolated or recombinantly produced. Thus, a peptide, polypeptide or fusion protein that is substantially free of cellular material includes preparations of a peptide, polypeptide or fusion protein having less than about 30%, 20%, 10%, or 5% (by dry weight) of heterologous protein (also referred to herein as a "contaminating protein"). When the peptide, polypeptide or fusion protein is recombinantly produced, it is also preferably substantially free of culture medium, i.e., culture medium represents less than about 20%, 10%, or 5% of the volume of the protein preparation. When the peptide, polypeptide or fusion protein is produced by chemical synthesis, it is preferably substantially free of chemical precursors or other chemicals, i.e., it is separated from chemical precursors or other chemicals which are involved in the synthesis of the peptide, polypeptide or fusion protein. Accordingly such preparations of a peptide, polypeptide, fusion protein or antibody have less than about 30%, 20%, 10%, 5% (by dry weight) of chemical precursors or compounds other than the peptide, polypeptide or fusion protein of interest.

As used herein, the term "isolated" in the context of nucleic acid molecules refers to a nucleic acid molecule which is separated from other nucleic acid molecules which are present in the natural source of the first nucleic acid molecule. Moreover, an "isolated" nucleic acid molecule, such as a cDNA molecule, is substantially free of other cellular material, or culture medium when produced by recombinant techniques, or substantially free of chemical precursors or other chemicals when chemically synthesized and may be free of cDNA or other genomic DNA molecules, e.g., has been isolated from other clones in a nucleic acid library.

The term "purified" means that the peptide, polypeptide, fusion protein or nucleic acid molecule has been measurably increased in concentration by any purification process, including but not limited to, column chromatography, HPLC, precipitation, electrophoresis, etc., thereby partially, substantially, or completely removing impurities such as precursors or other chemicals involved in preparing the peptide, polypeptide, fusion protein or nucleic acid molecule. One of skill in the art will appreciate the amount of purification necessary for a given use. For example, isolated protein meant for use in therapeutic compositions intended for administration to humans ordinarily must be of high purity in accordance with regulatory standards and good manufacturing processes.

As used herein, the term "derivative" in the context of polypeptides refers to a polypeptide that comprises an amino acid sequence which has been altered by the introduction of amino acid residue substitutions, deletions or additions. The term "derivative" as used herein also refers to a polypeptide that has been modified, i.e., by the covalent attachment of any type of molecule to the polypeptide. For example, but not by way of limitation, a polypeptide may be modified, e.g., by glycosylation, acetylation, pegylation, phosphorylation, amidation, derivatization by known protecting/blocking groups, proteolytic cleavage, linkage to a cellular ligand or other protein, etc. A derivative polypeptide may be produced by chemical modifications using techniques known to those of skill in the art, including, but not limited to specific chemical cleavage, acetylation, formylation, metabolic synthesis of tunicamycin, etc. Further, a derivative polypeptide may contain one or more non-classical amino acids. A polypeptide derivative possesses a similar or identical function as the polypeptide from which it was derived. The term "derived" as used in reference to a polypeptide "derived" from an organism may also refer to isolation of a polypeptide directly from said organism (e.g. bacterial cells or phage).

As used herein, the term "host cell" refers to the particular subject cell transfected with a nucleic acid molecule and the progeny or potential progeny of such a cell that contain the nucleic acid molecule or chromosomally integrated version thereof. Progeny of such a cell may not be identical to the parent cell transfected with the nucleic acid molecule due to mutations or environmental influences that may occur in succeeding generations or integration of the nucleic acid molecule into the host cell genome. For the expression of bacteriophage proteins and polypeptides, the host cell is preferably not of the same species or strain from which the bacteriophage was isolated or cultured.

As used herein, the term "in combination" refers to the use of more than one prophylactic and/or therapeutic agent. The use of the term "in combination" does not restrict the order in which prophylactic and/or therapeutic agents are administered to a subject with a disease or disorder. A first prophylactic or therapeutic agent can be administered prior to (e.g., 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks before), concomitantly with, or subsequent to (e.g., 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks after) the administration of a second prophylactic or therapeutic agent (different from the first prophylactic or therapeutic agent) to a subject with a disease or disorder.

As used herein, the terms "nucleic acids" and "nucleotide sequences" include single-stranded and double-stranded DNA and/or RNA molecules, or combinations thereof. As used herein, the term "encoded by the nucleic acid" refers to an amino acid sequence that results from the translation of the forward, reverse, complementary or reverse-complementary sequence of the referenced nucleic acid sequence using the standard genetic code (i.e., standard codon triplets) as well known in the art.

As used herein, the terms "prophylactic agent" and "prophylactic agents" refer to bacteriophages and/or polypeptides of the invention, which can be used in the prevention, treatment, management or amelioration of one or more symptoms associated with infection by a bacterium.

As used herein, the terms "therapeutic agent" and "therapeutic agents" refer to bacteriophages and/or polypeptides of the invention that can be used in the prevention, treatment, management or amelioration of one or more symptoms of a disease or disorder, in particular, a disease or disorder associated with a bacterial infection.

As used herein, the term "therapeutically effective amount" refers to that amount of a therapeutic agent sufficient to result in amelioration of one or more symptoms of a disease or disorder, in particular, a disease or disorder associated with a bacterial infection.

As used herein, the terms "treat", "treatment" and "treating" refer to the amelioration of one or more symptoms associated with a bacterial infection that results from the administration of one or more bacteriophages and/or polypeptides of the invention. As noted above, "treatment" and related terms refer to both therapeutic treatment and prophylactic or preventative measures, wherein the object is to eliminate, lessen, decrease the severity of, slow the progression of, or delay or prevent the symptoms or underlying cause (e.g., bacterial infection) associated with the pathological condition or disorder.

As used herein, the terms "antibacterial activity" and "antimicrobial activity" with reference to a bacteriophage, isolated bacteriophage protein (or variant, derivative or fragment thereof), or bacteriophage product, are used interchangeably to refer to the ability to kill and/or inhibit the growth or reproduction of a microorganism, in particular, the bacteria of the species or strain that the bacteriophage infects. In certain embodiments, antibacterial or antimicrobial activity is assessed by culturing bacteria (e.g., Gram-positive bacteria (e.g., *E. faecalis, E. faecium, S. aureus*), Gram-negative bacteria (e.g., *A. baumannii, P. aeruginosa*) or bacteria not classified as either Gram-positive or Gram-negative) according to standard techniques (e.g., in liquid culture or on agar plates), contacting the culture with a bacteriophage or polypeptide of the invention and monitoring cell growth after said contacting. For example, in a liquid culture, the bacteria may be grown to an optical density ("OD") representative of a midpoint in exponential growth of the culture; the culture is exposed to one or more concentrations of one or more bacteriophages or polypeptides of the invention and the OD is monitored relative to a control culture. Decreased OD relative to a control culture is representative of a bacteriophage or polypeptide exhibiting antibacterial activity (e.g., exhibits lytic killing activity). Similarly, bacterial colonies can be allowed to form on an agar plate, the plate exposed to a bacteriophage or polypeptide of the invention, and subsequent growth of the colonies evaluated related to control plates. Decreased size of colonies, or decreased total numbers of colonies, indicate a bacteriophage or polypeptide with antibacterial activity.

As used herein, a "CHAP domain" refers to a conserved amidase domain found in several phage-encoded peptidoglycan hydrolases and stands for for "cysteine, histidine-dependent amidohydrolases/peptidases." See, e.g., Rigden D, et. al., Trends Biochem Sci. 2003 May 28(5): 230-4. It is found in a superfamily of amidases, including GSP amidase and peptidoglycan hydrolases. The family includes at least two different types of peptidoglycan cleavage activities: L-muramoyl-L-alanine amidase and D-alanyl-glycyl endopeptidase activity. CHAP domains generally contain conserved cysteine and histidine residues and hydrolyze γ-glutamyl-containing substrates. These cysteine residues are believed to be essential for the activity of several of these amidases, and their thiol groups appear to function as the nucleophiles in the catalytic mechanisms of all enzymes containing this domain. CHAP domains are often found in association with other domains that cleave peptidoglycan, e.g., acting in a cooperative manner to cleave specialized substrates. See also, Bateman A, et al., Trends Biochem Sci. 2003 May 28(5): 234-7.

5. BRIEF DESCRIPTION OF THE FIGURES

FIG. 1: Schematic of the organization of the F168/08 genome, comprising the nucleic acid sequence of SEQ ID NO:1. The open reading frames ("ORFs") predicted in the genome are represented by arrows and numbered in black.

The direction of an arrow indicates the direction of transcription. Color coding: Black—ORFs for which products a functional assignment could be made based on the known functions of homologous proteins (ORFs encoding products exhibiting homology to the same or similar proteins are indicated using the same number and differentiated by lowercase letter); Gray—ORFs coding for products that are similar to proteins of unknown function; White or Empty—ORFs coding for proteins that share no significant homology with proteins in available databases. Functionally assigned ORFs are also listed in the figure. The information in the figure is also included in tabular form in FIG. 2.

FIGS. 2A-X: Features of the bacteriophage F168/08 genome, including gene products and assignment of putative functions. The figure includes a listing of the ORFs of the genome and provides for each ORF (i) its position within the genome, (ii) the encoded amino acid sequence, (iii) a listing of homologous proteins and conserved domains within its encoded polypeptide and (iv) an assignment of putative function. ORFs 1-116 listed in FIG. 2 encode the amino acid sequences of SEQ ID NO:8-130, respectively.

FIGS. 3A-B: The host range of F168/08 as determined by the spot test in 105 *Enterococcus faecalis* (EFS) (3A) and 56 *Enterococcus faecium* (EFM) (3B) strains isolated from clinical samples. Each spot contained 5 µl bacteriophage suspension with indicated titers (prepared from CsCl purified lysate). Sensitivity of each strain to the phage was evaluated based on a relative scale ranging from turbid (+) to clear (++++) lysis halos. Resistance to phage infection is indicated as (−).

Figure 4:
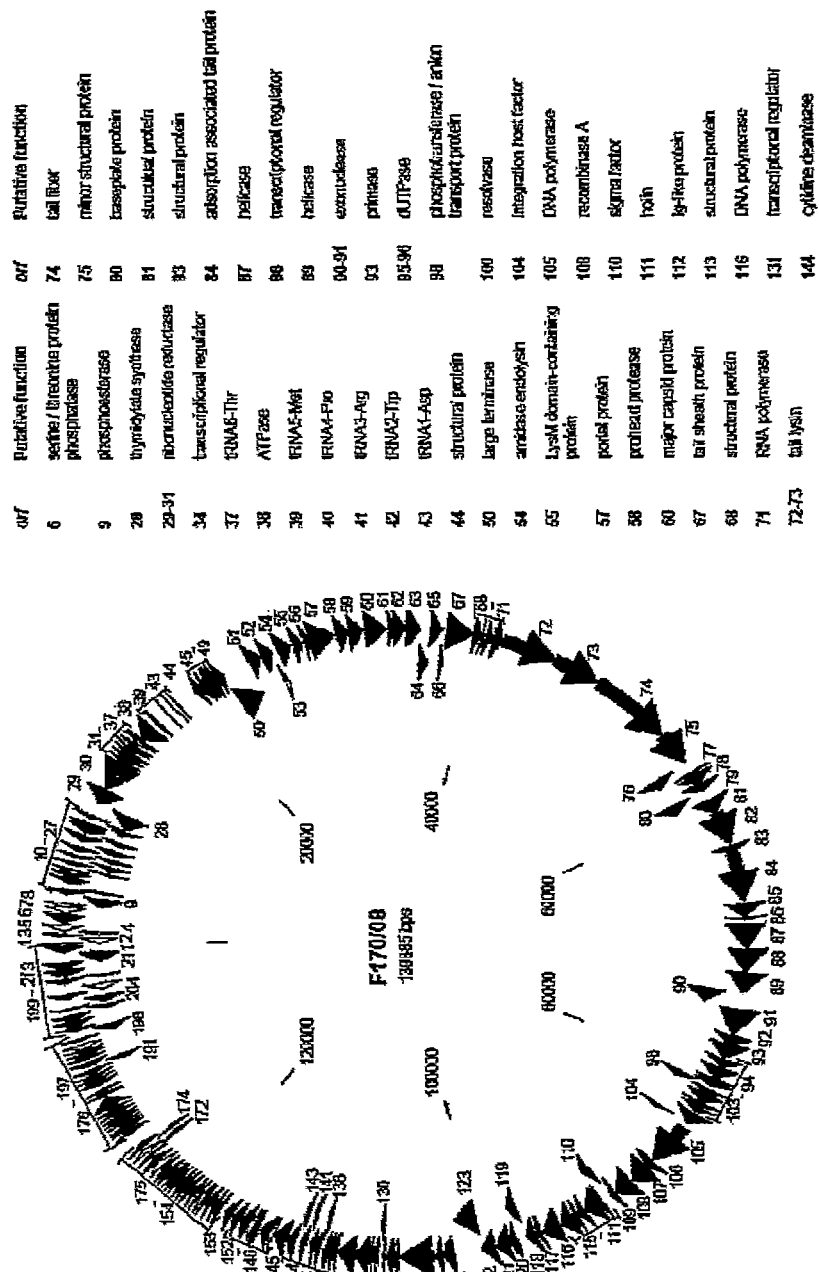

FIG. 4: Schematic of the organization of the F170/08 genome, comprising the nucleic acid sequence of SEQ ID NO:2. The ORFs predicted in the genome are represented by arrows and numbered in black. The direction of an arrow indicates the direction of transcription. Color coding: Black—ORFs for which products a functional assignment could be made based on the known functions of homologous proteins (ORFs encoding products exhibiting homology to the same or similar proteins are indicated using the same number and differentiated by lowercase letter); Gray—ORFs coding for products that are similar to proteins of unknown function; White or Empty—ORFs coding for proteins that share no significant homology with proteins in available databases. Functionally assigned ORFs are also listed in the figure. The information in the figure is also included in tabular form in FIG. 5.

FIGS. 5A-AU: Features of the bacteriophage F170/08 genome, including gene products and assignment of putative functions. The figure includes a listing of the ORFs of the genome and provides for each ORF (i) its position within the genome, (ii) the encoded amino acid sequence, (iii) a listing of homologous proteins and conserved domains within its encoded polypeptide and (iv) an assignment of putative function. ORFs 1-213 listed in FIG. 5 encode the amino acid sequences of SEQ ID NO:131-343, respectively.

FIGS. 6A-B: The host range of F170/08 as determined by the spot test in 105 *Enterococcus faecalis* (EFS) (6A) and 56 *Enterococcus faecium* (EFM) (6B) strains isolated from clinical samples. Each spot contained 5 µl bacteriophage suspension with indicated titers (prepared from CsCl purified lysate). Sensitivity of each strain to the phage was evaluated based on a relative scale ranging from turbid (+) to clear (++++) lysis halos. Resistance to phage infection is indicated as (−).

Figure 7:
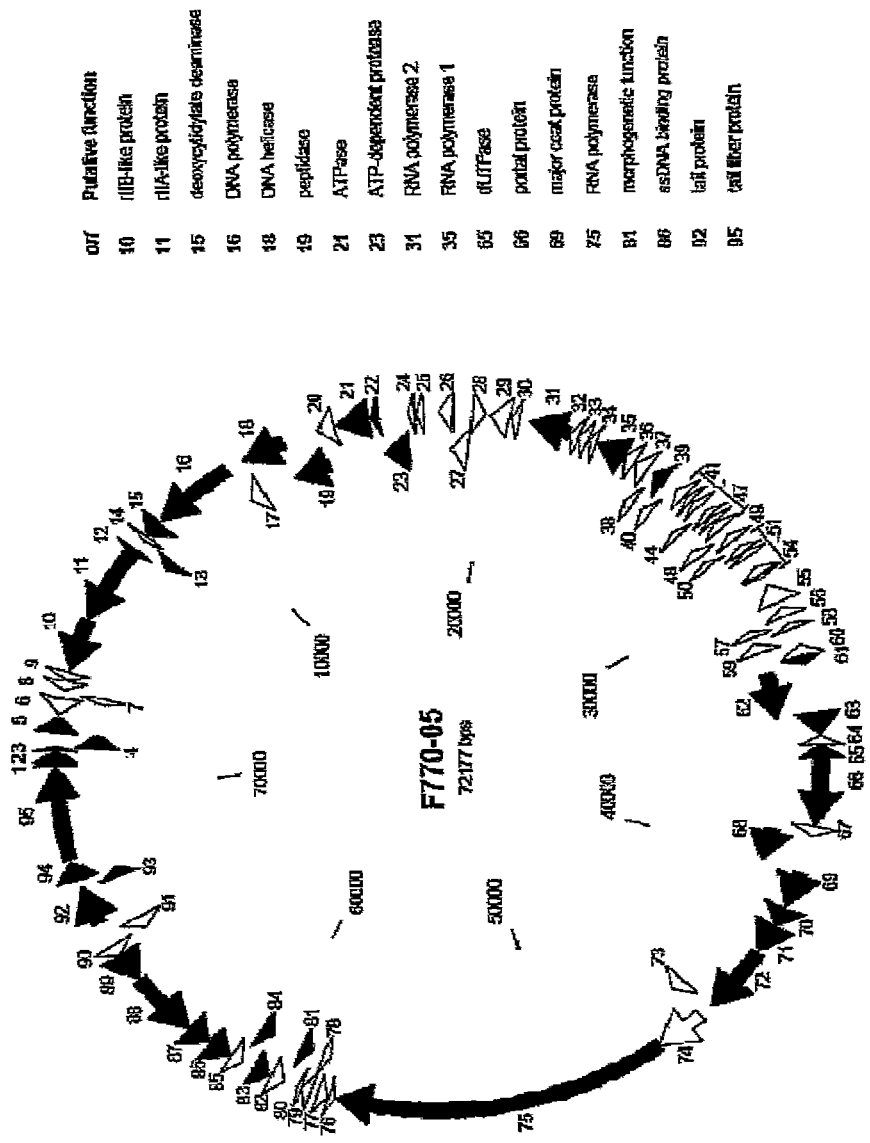

FIG. 7: Schematic of the organization of the F770/05 genome, comprising the nucleic acid sequence of SEQ ID NO:3. The ORFs predicted in the genome are represented by arrows and numbered in black. The direction of an arrow indicates the direction of transcription. Color coding: Black—ORFs for which products a functional assignment could be made based on the known functions of homologous proteins (ORFs encoding products exhibiting homology to the same or similar proteins are indicated using the same number and differentiated by lowercase letter); Gray—ORFs coding for products that are similar to proteins of unknown function; White or Empty—ORFs coding for proteins that share no significant homology with proteins in available databases. Functionally assigned ORFs are also listed in the figure. The information in the figure is also included in tabular form in FIG. 8.

FIGS. 8A-AE: Features of the bacteriophage F770/05 genome, including gene products and assignment of putative functions. The figure includes a listing of the ORFs of the genome and provides for each ORF (i) its position within the genome, (ii) the encoded amino acid sequence, (iii) a listing of homologous proteins and conserved domains within its encoded polypeptide and (iv) an assignment of putative function. ORFs 1-95 listed in FIG. 8 encode the amino acid sequences of SEQ ID NO:344-438, respectively.

FIG. 9: The host range of F770/05 as determined by the spot test in 100 *Pseudomonas aeruginosa* (PSA) strains isolated from clinical samples. Each spot contained 5 µl bacteriophage suspension with indicated titers (prepared from CsCl purified lysate). Sensitivity of each strain to the phage was evaluated based on a relative scale ranging from turbid (+) to clear (++++) lysis halos. Resistance to phage infection is indicated as (−).

Figure 10:
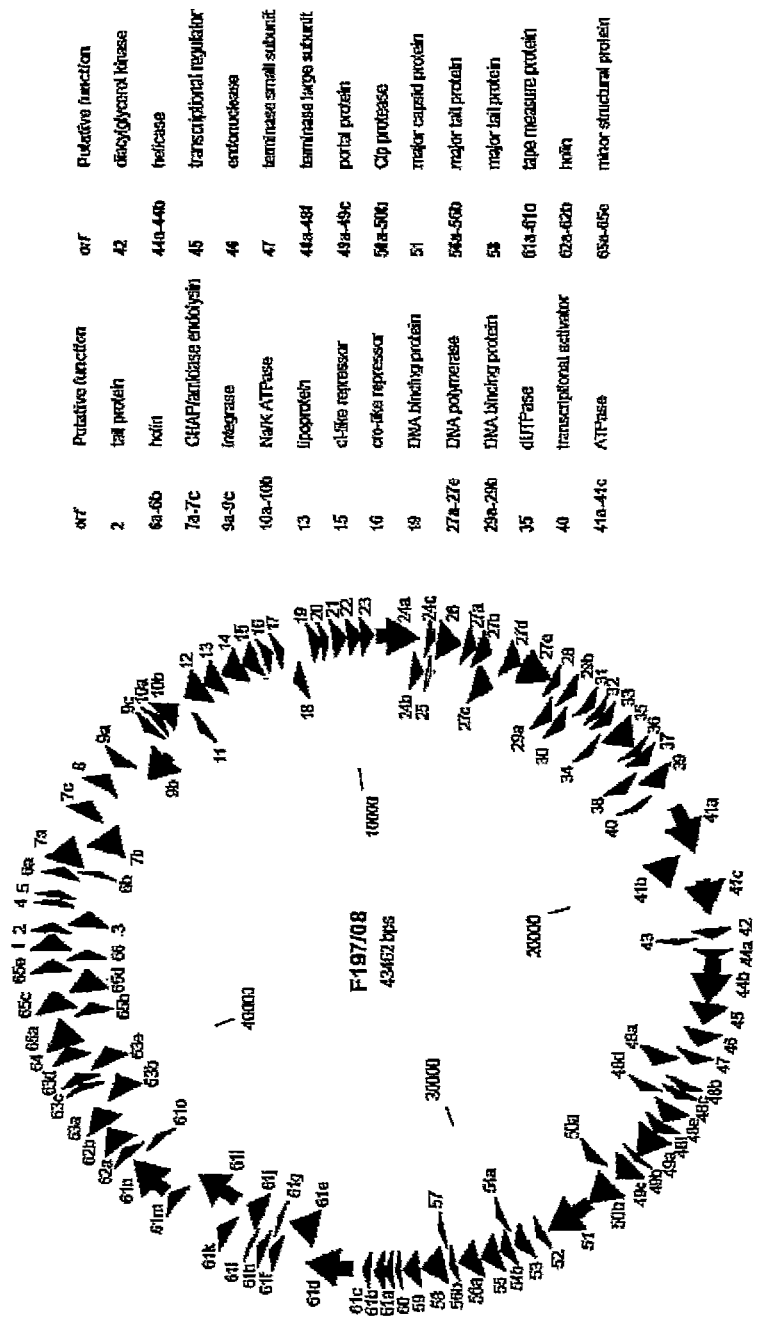

FIG. 10: Schematic of the organization of the F197/08 genome, comprising the nucleic acid sequence of SEQ ID NO:4. The ORFs predicted in the genome are represented by arrows and numbered in black. The direction of an arrow indicates the direction of transcription. Color coding: Black—ORFs for which products a functional assignment could be made based on the known functions of homologous proteins (ORFs encoding products exhibiting homology to the same or similar proteins are indicated using the same number and differentiated by lowercase letter); Gray—ORFs coding for products that are similar to proteins of unknown function; White or Empty—ORFs coding for proteins that share no significant homology with proteins in available databases. Functionally assigned ORFs are also listed in the figure. The information in the figure is also included in tabular form in FIG. 11.

FIGS. 11A-AA: Features of the bacteriophage F197/08 genome, including gene products and assignment of putative functions. The figure includes a listing of the ORFs of the genome and provides for each ORF (i) its position within the genome, (ii) the encoded amino acid sequence, (iii) a listing of homologous proteins and conserved domains within its encoded polypeptide and (iv) an assignment of putative function. ORFs 1-66 listed in FIG. 11 encode the amino acid sequences of SEQ ID NO:439-553, respectively.

FIG. 12: The host range of F197/08 as determined by the spot test in 100 *Staphylococcus aureus* (STA) strains isolated from clinical samples. Each spot contained 5 µl bacteriophage suspension with indicated titers (prepared from CsCl purified lysate). Sensitivity of each strain to the phage was evaluated based on a relative scale ranging from turbid (+) to clear (++++) lysis halos. Resistance to phage infection is indicated as (−).

Figure 13:
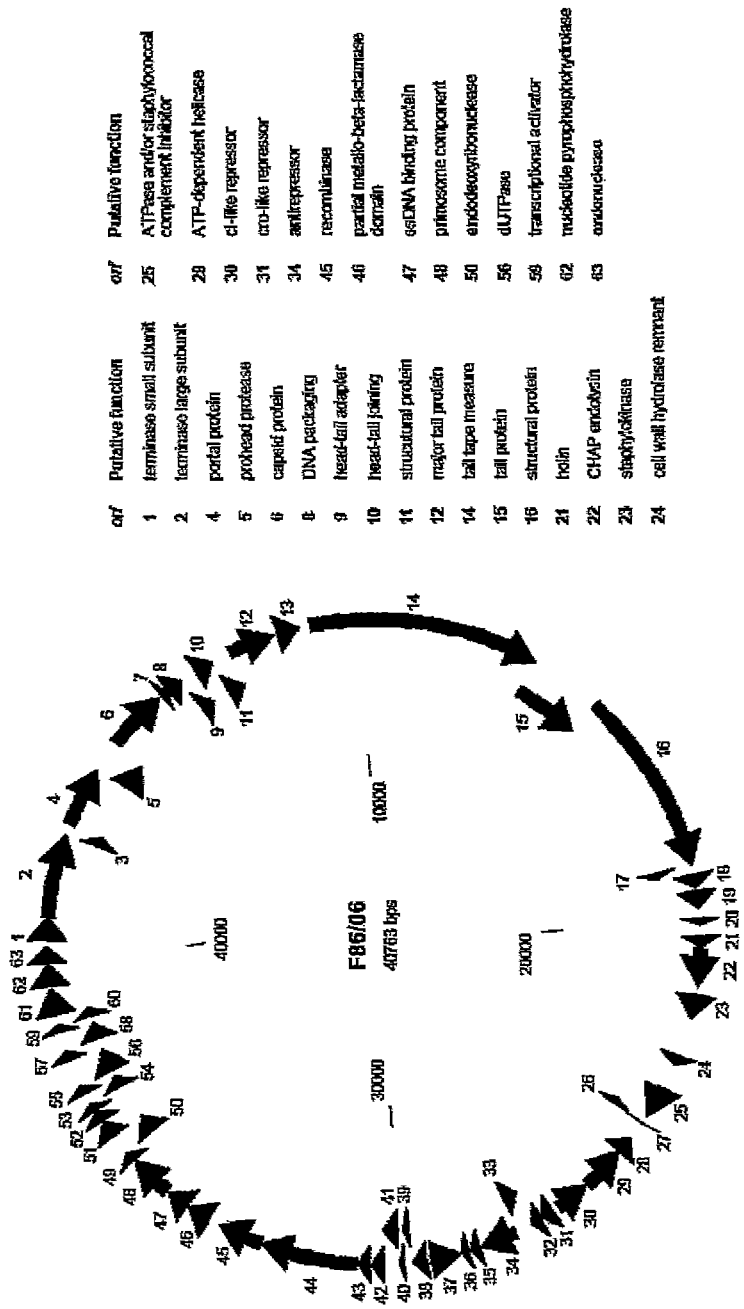

FIG. 13: Schematic of the organization of the F86/06 genome, comprising the nucleic acid sequence of SEQ ID NO:5. The ORFs predicted in the genome are represented by arrows and numbered in black. The direction of an arrow indicates the direction of transcription. Color coding: Black—ORFs for which products a functional assignment could be made based on the known functions of homologous proteins (ORFs encoding products exhibiting homology to the same or similar proteins are indicated using the same number and differentiated by lowercase letter); Gray—ORFs coding for products that are similar to proteins of unknown function; White or Empty—ORFs coding for proteins that share no significant homology with proteins in available databases. Functionally assigned ORFs are also listed in the figure. The information in the figure is also included in tabular form in FIG. 14.

FIGS. 14A-U: Features of the bacteriophage F86/06 genome, including gene products and assignment of putative functions. The figure includes a listing of the ORFs of the genome and provides for each ORF (i) its position within the genome, (ii) the encoded amino acid sequence, (iii) a listing of homologous proteins and conserved domains within its encoded polypeptide and (iv) an assignment of putative function. ORFs 1-63 listed in FIG. 14 encode the amino acid sequences of SEQ ID NO:554-616, respectively.

FIG. 15: The host range of F86/06 as determined by the spot test in 100 *Staphylococcus aureus* (STA) strains isolated from clinical samples. Each spot contained 5 µl bacteriophage suspension with indicated titers (prepared from CsCl purified lysate). Sensitivity of each strain to the phage was evaluated based on a relative scale ranging from turbid (+) to clear (++++) lysis halos. Resistance to phage infection is indicated as (−).

Figure 16:
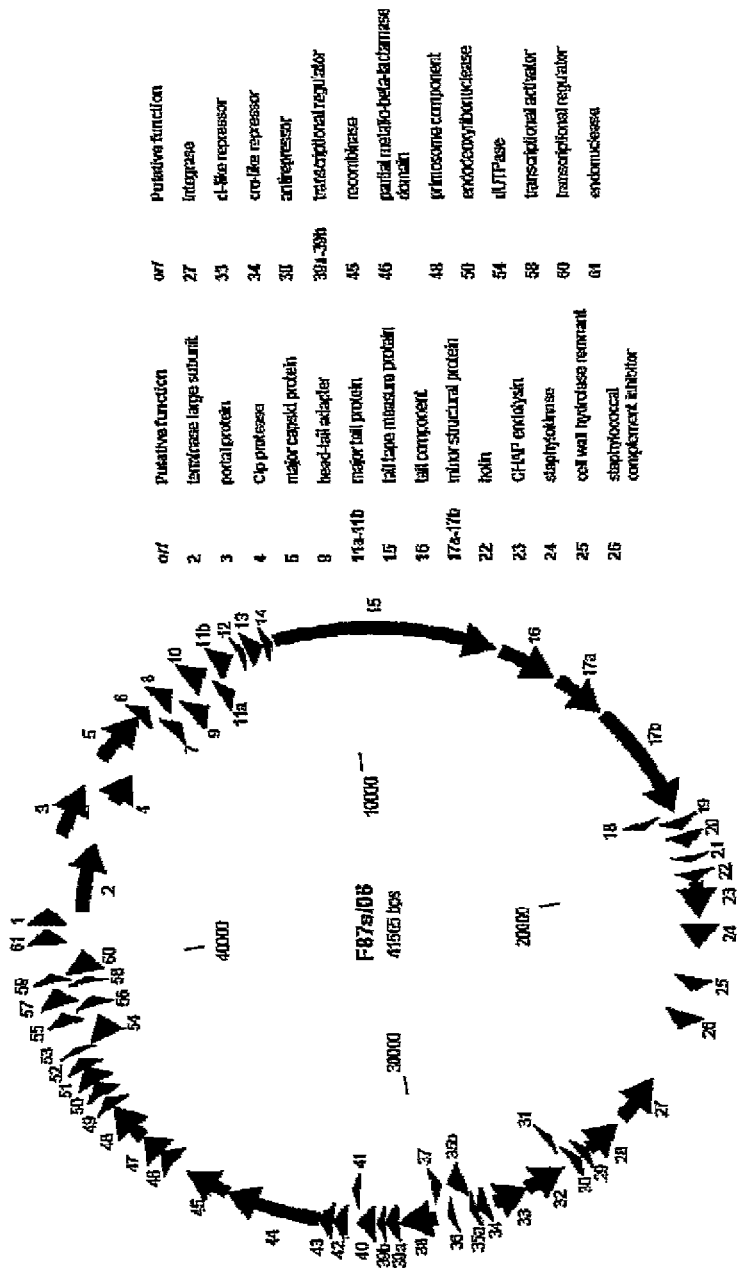

FIG. 16: Schematic of the organization of the F87s/06 genome, comprising the nucleic acid sequence of SEQ ID NO:6. The ORFs predicted in the genome are represented by arrows and numbered in black. The direction of an arrow indicates the direction of transcription. Color coding: Black—ORFs for which products a functional assignment could be made based on the known functions of homologous proteins (ORFs encoding products exhibiting homology to the same or similar proteins are indicated using the same number and differentiated by lowercase letter); Gray—ORFs coding for products that are similar to proteins of unknown function; White or Empty—ORFs coding for proteins that share no significant homology with proteins in available databases. Functionally assigned ORFs are also listed in the figure. The information in the figure is also included in tabular form in FIG. 17.

FIGS. 17A-V: Features of the bacteriophage F87s/06 genome, including gene products and assignment of putative functions. The figure includes a listing of the ORFs of the genome and provides for each ORF (i) its position within the genome, (ii) the encoded amino acid sequence, (iii) a listing of homologous proteins and conserved domains within its encoded polypeptide and (iv) an assignment of putative function. ORFs 1-61 listed in FIG. 17 encode the amino acid sequences of SEQ ID NO:617-681, respectively.

FIG. 18: The host range of F87s/06 as determined by the spot test in 100 *Staphylococcus aureus* (STA) strains isolated from clinical samples. Each spot contained 5 µl bacteriophage suspension with indicated titers (prepared from CsCl purified lysate). Sensitivity of each strain to the phage was evaluated based on a relative scale ranging from turbid (+) to clear (++++) lysis halos. Resistance to phage infection is indicated as (−).

Figure 19:
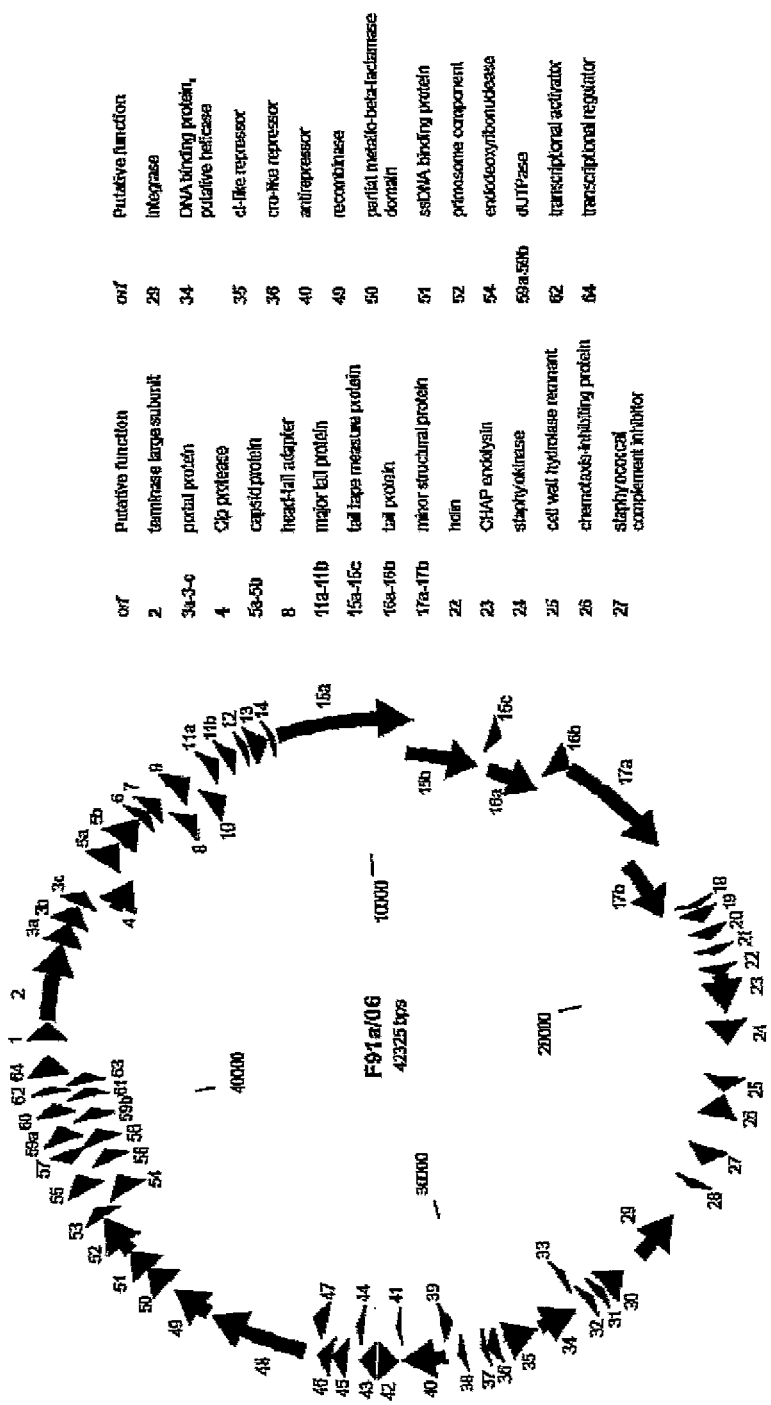

FIG. 19: Schematic of the organization of the F91a/06 genome, comprising the nucleic acid sequence of SEQ ID NO:7. The ORFs predicted in the genome are represented by arrows and numbered in black. The direction of an arrow indicates the direction of transcription. Color coding: Black—ORFs for which products a functional assignment could be made based on the known functions of homologous proteins (ORFs encoding products exhibiting homology to the same or similar proteins are indicated using the same number and differentiated by lowercase letter); Gray—ORFs coding for products that are similar to proteins of unknown function; White or Empty—ORFs coding for proteins that share no significant homology with proteins in available databases. Functionally assigned ORFs are also listed in the figure. The information in the figure is also included in tabular form in FIG. 20.

Figure 20I:
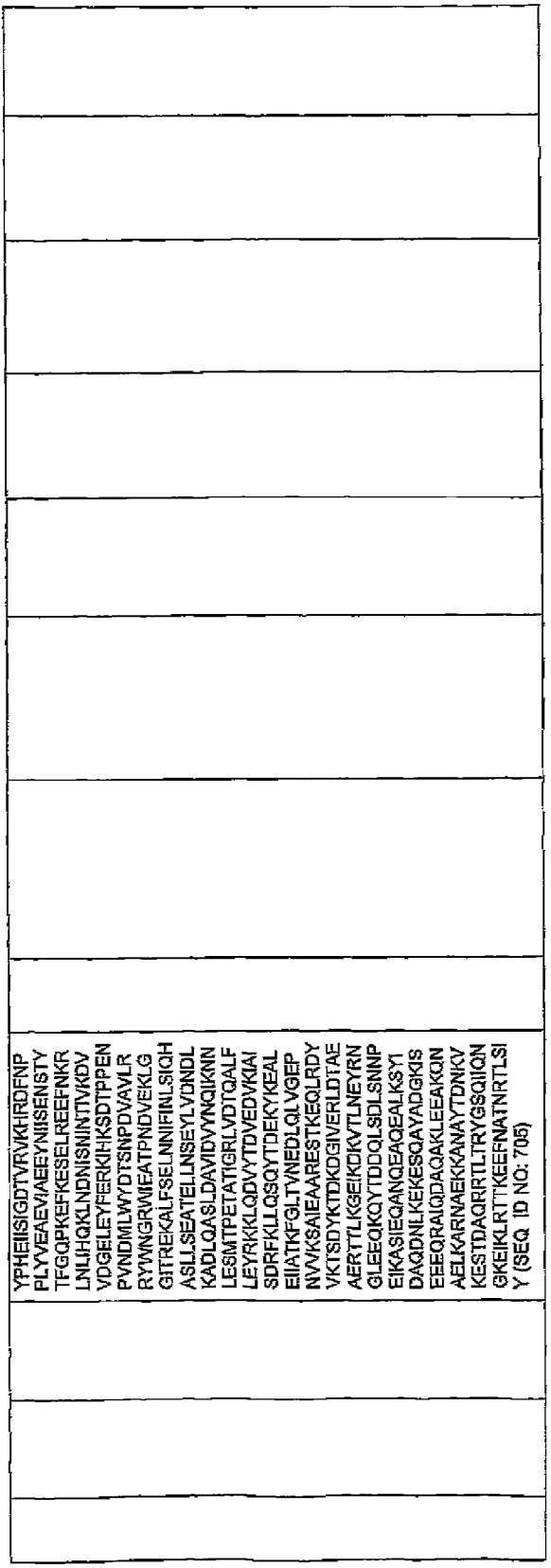

FIGS. 20A-U: Features of the bacteriophage F91a/06 genome, including gene products and assignment of putative functions. The figure includes a listing of the ORFs of the genome and provides for each ORF (i) its position within the genome, (ii) the encoded amino acid sequence, (iii) a listing of homologous proteins and conserved domains within its encoded polypeptide and (iv) an assignment of putative function. ORFs 1-64 listed in FIG. 20 encode the amino acid sequences of SEQ ID NO:682-754, respectively.

FIG. 21: The host range of F91a/06 as determined by the spot test in 100 *Staphylococcus aureus* (STA) strains isolated from clinical samples. Each spot contained 5 µl bacteriophage suspension with indicated titers (prepared from CsCl purified lysate). Sensitivity of each strain to the phage was evaluated based on a relative scale ranging from turbid (+) to clear (++++) lysis halos. Resistance to phage infection is indicated as (−).

Figure 22:
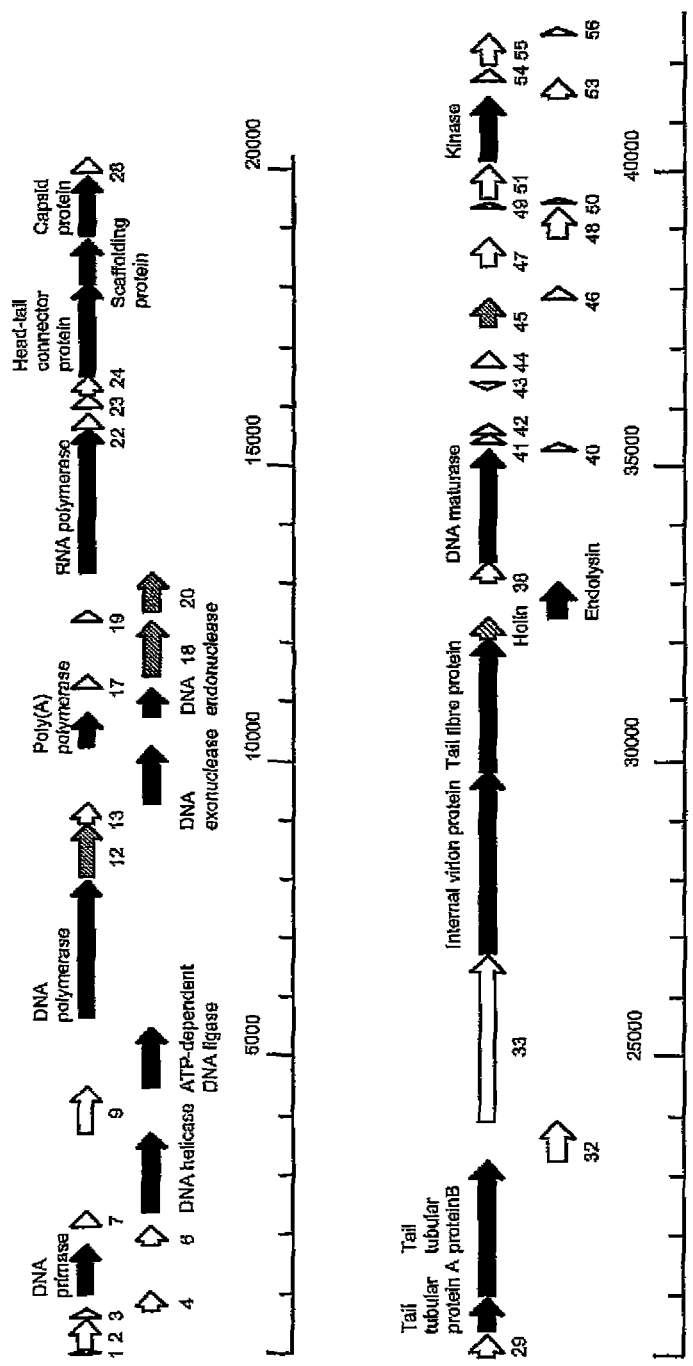

FIG. 22: Schematic organization of the F1245/05 genome, comprising the nucleic acid sequence of SEQ ID NO:760. The ORFs predicted in the 43kb genome are represented by arrows and numbered in black. For the ORFs functionally assigned, the number is substituted by the predicted function. The direction of an arrow indicates the direction of transcription. Color coding: Black—ORFs for whose products a functional assignment could be made based on homologous proteins; Gray—ORFs coding for products that are similar to proteins of unknown function; Striped—ORFs with an assigned function based on its relative genome position and on the presence of putative transmembrane domains in the encoded product; Empty arrows—ORFs coding for proteins that share no significant homology with proteins in databases.

FIGS. 23A-O: Features of bacteriophage F1245/05 genome, including gene products and assignment of putative functions are provided.

FIGS. 24A-E: The host range of F1245/05 as determined by the spot test in 100 *Acinetobacter baumannii* strains isolated from clinical samples is provided. Each spot contained 5 µl bacteriophage suspensions with indicated titers (prepared from CsCI purified lysate). Sensitivity to the phage is presented as a scale ranging from turbid (+) to clear (++++) lysis halos. Resistance to phage infection is indicated as (−).

6. DETAILED DESCRIPTION

The present invention is directed to isolated bacteriophages, and their isolated polypeptide products, having antibacterial activity against one or more species or strains of the nosocomial pathogens *A. baumannii, E. faecalis, E. faecium, P. aeruginosa* and *S. aureus*. In one embodiment, isolated bacteriophages or polypeptides are provided that exhibit antimicrobial and/or antibacterial activity against methicillin resistant strains of *S. aureus* (MRSA). In addition, the bacteriophages and polypeptides of the invention may exhibit antibacterial or antimicrobial activity against one or more species or strains of pathogenic bacteria including, but not limited to, *S. epidermidis, S. auricularis, S. capitis, S. haemolyticus, S.*

*hominis, S. saprophyticus, S. simulans, S. xylosis, Micrococcus luteus, Bacilus subtilis, B. pumilus, E. hirae* and *E. avium*.

In one embodiment, the invention provides a bacteriophage having a genome comprising or consisting of the nucleic acid sequence of SEQ ID NO:1. A specific example in accordance with this embodiment is the isolated bacteriophage F168/08, which targets a number of strains of *E. faecalis* and *E. faecium*. Open reading frames (ORFs) in the F168/08 genome, the amino acid sequences encoded by the ORFs and the assignment of putative functions of the encoded amino acid sequences (i.e., encoded proteins and/or polypeptides) are provided in FIG. 2 (also providing the amino acid sequences SEQ ID NOS:8-130).

*Enterococci* are gram-positive, spherical bacteria that form colonies in groups or chains. They are found as part of the digestive tract flora in many mammals, including humans. *Enterococcus* infections account for 12% of all nosocomial infections. An *Enterococcus* infection can cause complicated abdominal infections, skin and skin structure infections, urinary tract infections and infections of the blood stream, which can be difficult to treat, particularly in cases where the strain involved has developed resistance to several antibiotics. In such instances, infection can be life threatening, especially where the patient is already immunodeficient.

*Enterococcus faecalis* accounts for the majority of *Enterococci* infections and is a Gram-positive commensal bacterium inhabiting the gastrointestinal tracts of humans and other mammals. It is non-motile and facultatively anaerobic. *E. faecalis* can cause endocarditis, as well as bladder, prostate, and epididymal infections, including life threatening infections in humans, especially in the nosocomial environment. *E. faecalis* is resistant to many commonly used antimicrobial agents (such as, e.g., aminoglycosides, aztreonam, cephalosporins, clindamycin, the semi-synthetic penicillins nafcillin and oxacillin, trimethoprim-sulfamethoxazole, and the like).

*Enterococcus faecium* is known to have a resistance to several types of antibiotics including quinolones and aminoglycosides. Vancomycin-resistant strains of *E. faecium* are also known. Resistance to several antibiotics and tolerance for adverse conditions makes *E. faecium* a major concern for the medical community, which has dubbed this microbe a "supergerm". In another embodiment, the invention provides a bacteriophage having a genome comprising or consisting of the nucleic acid sequence of SEQ ID NO:2. A specific example in accordance with this embodiment is the isolated bacteriophage F170/08, which targets a number of strains of *E. faecalis* and *E. faecium*. Open reading frames (ORFs) in the F178/08 genome, the amino acid sequences encoded by the ORFs and the assignment of putative functions of the encoded amino acid sequences (i.e., encoded proteins and/or polypeptides) are provided in FIG. 5 (also providing the amino acid sequences SEQ ID NOS:131-343).

In still another embodiment, the invention provides a bacteriophage having a genome comprising or consisting of the nucleic acid sequence of SEQ ID NO:3. A specific example in accordance with this embodiment is the isolated bacteriophage F770/05, which targets a number of strains of *P. aeruginosa*. Open reading frames (ORFs) in the F770/05 genome, the amino acid sequences encoded by the ORFs and the assignment of putative functions of the encoded amino acid sequences (i.e., encoded proteins and/or polypeptides) are provided in FIG. 8 (also providing the amino acid sequences SEQ ID NOS:344-438).

*Pseudomonas aeruginosa* is a common Gram-negative rod-shaped bacterium found in soil, water, skin flora and most man-made environments. It thrives not only in normal atmospheres, but also with little oxygen as a facultative anaerobe, and can infect damaged tissues or immunocomromised inidviduals. When such colonisations occur in critical body organs such as the lungs, the urinary tract, and kidneys, the results can be fatal. Because it thrives on surfaces, this bacterium is also found on and in medical equipment including catheters, causing cross infections in hospitals and clinics. *P. aeruginosa* is one of the most relevant opportunistic, nosocomial pathogens, and it has been estimated that one in ten hosptical-acquired infections are from *Pseudomonas*. *P. aeruginosa* is also the most common cause of burn injury infections and the most frequent colonizer of medical devices, such as catheters.

In yet another embodiment, the invention provides a bacteriophage having a genome comprising or consisting of the nucleic acid sequence of SEQ ID NO:4. A specific example in accordance with this embodiment is the isolated bacteriophage F197/08, which targets a number of strains of *S. aureus*. Open reading frames (ORFs) in the F197/08 genome, the amino acid sequences encoded by the ORFs and the assignment of putative functions of the encoded amino acid sequences (i.e., encoded proteins and/or polypeptides) are provided in FIG. 11 (also providing the amino acid sequences SEQ ID NOS:439-553).

In yet another embodiment, the invention provides a bacteriophage having a genome comprising or consisting of the nucleic acid sequence of SEQ ID NO:5. A specific example in accordance with this embodiment is the isolated bacteriophage F86/06, which targets a number of strains of *S. aureus*. Open reading frames (ORFs) in the F86/06 genome, the amino acid sequences encoded by the ORFs and the assignment of putative functions of the encoded amino acid sequences (i.e., encoded proteins and/or polypeptides) are provided in FIG. 14 (also providing the amino acid sequences SEQ ID NOS:554-616).

In yet another embodiment, the invention provides a bacteriophage having a genome comprising or consisting of the nucleic acid sequence of SEQ ID NO:6. A specific example in accordance with this embodiment is the isolated bacteriophage F87s/06, which targets a number of strains of *S. aureus*. Open reading frames (ORFs) in the F87s/06 genome, the amino acid sequences encoded by the ORFs and the assignment of putative functions of the encoded amino acid sequences (i.e., encoded proteins and/or polypeptides) are provided in FIG. 17 (also providing the amino acid sequences SEQ ID NOS:617-681).

In still another embodiment, the invention provides a bacteriophage having a genome comprising or consisting of the nucleic acid sequence of SEQ ID NO:7. A specific example in accordance with this embodiment is the isolated bacteriophage F91a/06, which targets a number of strains of *S. aureus*. Open reading frames (ORFs) in the F91a/06 genome, the amino acid sequences encoded by the ORFs and the assignment of putative functions of the encoded amino acid sequences (i.e., encoded proteins and/or polypeptides) are provided in FIG. 20 (also providing the amino acid sequences SEQ ID NOS:682-754).

*S. aureus* is a spherical, facultatively-anaerobic, Gram-positive bacterium, often part of the skin flora found in the nose and on skin. *S. aureus* can cause a range of illnesses from minor skin infections, such as pimples, to gastroenteritis, to life-threatening diseases such as pneumonia, meningitis, osteomyelitis, endocarditis, toxic shock syndrome (TSS), bacteremia, and sepsis. It is one of the five most common causes of nosocomial infections, and often the cause of post-surgical wound infections. Today, *S. aureus* has become resistant to many commonly used antibiotics, and it has been estimated that only 2% of all *S. aureus* isolates are sensitive to penicillin. Second-generation penicillins, such s methicillin, oxacillin, cloxacillin and flucloxacillin, were developed to treat penicillin-resistant *S. aureus*. Methicillin was the first antibiotic in this class to be used, but only two years later, the first case of methicillin-resistant *S. aureus* (MRSA) was reported. Since the 1990s, there has been an explosion in MRSA prevalence in hospitals, where it is now considered an endemic.

In still another embodiment, the invention provides a bacteriophage having a genome comprising or consisting of the nucleic acid sequence of SEQ ID NO:760. A specific example in accordance with this embodiment is the isolated bacteriophage F1245/05, which targets a number of strains of *A. baumannii*. Open reading frames (ORFs) in the F1245/05 genome, the amino acid sequences encoded by the ORFs and the assignment of putative functions of the encoded amino acid sequences (i.e., encoded proteins and/or polypeptides) are provided in FIG. 23 (also providing the amino acid sequences SEQ ID NOS:761-816).

*Acinetobacter baumannii* is a species of bacteria that causes a number of severe clinical infections, particularly in individuals with compromised immune systems. *Acinetobacter baumannii* is a pleomorphic aerobic gram-negative bacillus that is commonly isolated from the hospital environment and from hospitalized patients. The bacterium often enters the body open wounds, catheters, or breathing tubes. *Acinetobacter baumannii* usually colonizes aquatic environments and is often cultured from hospitalized patients' sputum or respiratory secretions, wounds, and urine. In a hospital setting, *Acinetobacter baumannii* commonly colonizes irrigating solutions and intravenous solutions. It is also known to be resistant to multiple antibiotics and the number of nosocomial infections caused by *A. baumanni* has increased in recent years.

In certain embodiments, the bacteriophage of the invention comprises or consists of a genome having a sequence identity of at least 85%, 90%, 95%, 96%, 97%, 98% or at least 99% with the nucleic acid sequence of SEQ ID NO:1, SEQ ID NO:2, SEQ ID NO:3, SEQ ID NO:4, SEQ ID NO:5, SEQ ID NO:6, SEQ ID NO:7, or SEQ ID NO:760, which bacteriophage exhibits at least one biological, e.g., antimicrobial or antibacterial activity (e.g., lytic killing activity), of one or more of bacteriophage F168/08, F170/08, F770/05, F197/08, F86/06, F87s/06, F91a/06 and F1245/05. Alternatively or in addition, the bacteriophage of the invention may have a genome comprising a functional fragment of the nucleic acid sequence of SEQ ID NO:1, SEQ ID NO:2, SEQ ID NO:3, SEQ ID NO:4, SEQ ID NO:5, SEQ ID NO:6, SEQ ID NO:7, or SEQ ID NO:760, including the sequences of any of the open reading frames described in FIGS. 2, 5, 8, 11, 14, 17, 20, and 23.

The invention also provides for isolated bacteria infected with one or more of the bacteriophages of the invention. In certain embodiments, the invention provides isolated *E. faecalis* or *E. faecium* infected with a bacteriophage having a genome comprising or consisting of the nucleic acid sequence of SEQ ID NO:1 and/or SEQ ID NO:2. In other embodiments, the invention provides isolated *P. aeruginosa* infected with a bacteriophage having a genome comprising or consisting of the nucleic acid sequence of SEQ ID NO:3. In still other embodiments, the invention provides isolated *S. aureus* infected with a bacteriophage having a genome comprising or consisting of the nucleic acid sequence of SEQ ID NO:4, SEQ ID NO:5, SEQ ID NO:6 and/or SEQ ID NO:7. In yet still other embodiments, the invention provides isolated *A. baumannii* infected with a bacteriophage having a genome comprising or consisting of the nucleic acid sequence of SEQ ID NO:760.

The invention provides for methods of production and isolation of a bacteriophage having a genome comprising or consisting of the nucleic acid sequence of SEQ ID NO:1, SEQ ID NO:2, SEQ ID NO:3, SEQ ID NO:4, SEQ ID NO:5, SEQ ID NO:6, SEQ ID NO:7, or SEQ ID NO:760. In certain embodiments, the invention provides for a method of producing and/or isolating a bacteriophage having a genome that comprises or consists of the nucleic acid sequence of SEQ ID NO:1 or SEQ ID NO:2 comprising (i) obtaining a culture of *E. faecalis* or *E. faecium*, (ii) infecting it with the bacteriophage having a genome comprising or consisting of the nucleic acid sequence of SEQ ID NO:1 or SEQ ID NO:2; (iii) culturing until significant lysis of the culture is observed and (iv) isolating from the culture the bacteriophage. In other embodiments, the invention provides for a method of producing and/or isolating a bacteriophage having a genome that comprises or consists of the nucleic acid sequence of SEQ ID NO:3 comprising (i) obtaining a culture of *P. aeruginosa*, (ii) infecting it with the bacteriophage having a genome comprising or consisting of the nucleic acid sequence of SEQ ID NO:3; (iii) culturing until significant lysis of the culture is observed and (iv) isolating from the culture the bacteriophage. In still other embodiments, the invention provides for a method of producing and/or isolating a bacteriophage having a genome that comprises or consists of the nucleic acid sequence of SEQ ID NO:4, SEQ ID NO:5, SEQ ID NO:6 or SEQ ID NO:7 comprising (i) obtaining a culture of *S. aureus*, (ii) infecting it with the bacteriophage having a genome comprising or consisting of the nucleic acid sequence of ID NO:4, SEQ ID NO:5, SEQ ID NO:6 or SEQ ID NO:7; (iii) culturing until significant lysis of the culture is observed and (iv) isolating from the culture the bacteriophage. In yet still other embodiments, the invention provides for a method of producing and/or isolating a bacteriophage having a genome that comprises or consists of the nucleic acid sequence of SEQ ID NO:760 comprising (i) obtaining a culture of *A. baumannii*, (ii) infecting it with the bacteriophage having a genome comprising or consisting of the nucleic acid sequence of SEQ ID NO:760; (iii) culturing until significant lysis of the culture is observed and (iv) isolating from the culture the bacteriophage.

Bacteriophage may be isolated from a bacterial sample using any method described herein or known in the art (see, e.g., Carlson, "Working with bacteriophages: common techniques and methodological approaches," In, Kutter and Sulakvelidze (Eds) Bacteriophages: Biology and Applications, 5$^{th}$ ed. CRC Press (2005); incorporated herein by reference in its entirety).

The invention also provides for polypeptides isolated from bacteriophages of the invention. The isolated polypeptides may be full length bacteriophage proteins or may be fragments, variants or derivatives of the bacteriophage proteins provided that the fragment, variant or derivative exhibit at least one biological activity associated with the bacteriophage or polypeptide from which it is derived. In certain embodiments, the polypeptides of the invention are isolated from bacteriophage F1245/05 (which typically infects *A. baumannii*), F168/08 or F170/08 (which typically infects *E. faecalis* and/or *E. faecium*), bacteriophage F770/05 (which typically infects *P. aeruginosa*) or bacteriophage F197/08, F86/06, F87s/06 or F91a/06 (which typically infect *S. aureus*).

In specific embodiments, the polypeptide of the invention is an endolysin or lysin isolated from a bacteriophage having a genome comprising or consisting of SEQ ID NO:1, SEQ ID NO:2, SEQ ID NO:4, SEQ ID NO:5, SEQ ID NO:6, SEQ ID NO:7, or SEQ ID NO:760 (e.g., bacteriophage F168/08, F170/08, F197/08, F86/06, F87s/06, F91a/06, or F1245/05 respectively). In specific embodiments, the polypeptide of the invention is an endolysin or lysin having the amino acid sequence comprising or consisting of SEQ ID NO:797, SEQ ID NO:68, SEQ ID NO:184, SEQ ID NO:202, SEQ ID NO:203, SEQ ID NO:446, SEQ ID NO:447, SEQ ID NO:448, SEQ ID NO:575, SEQ ID NO:641 or SEQ ID NO:712. In other embodiments, the isolated polypeptide of the invention is a fragment, variant or derivative of an endolysin or lysin isolated from a bacteriophage of the invention, which fragment, variant or derivative exhibits at least one biological activity, preferably antibacterial activity (e.g., lytic killing activity), of the endolysin, lysin or bacteriophage from which it is isolated or derived. Accordingly, in certain embodiments, the invention provides isolated polypeptides that are fragments, variants or derivatives of endolysins or lysins isolated from bacteriophages of the invention, which fragments, variants or derivatives exhibit antibacterial or antimicrobial activity (e.g., lytic killing activity) against one or more of A. baumannii, E. faecalis, E. faecium or S. aureus. In other embodiments, the isolated polypeptides that are fragments, variants or derivatives of endolysins or lysins isolated from bacteriophages of the invention that exhibit antibacterial or antimicrobial activity (e.g., lytic killing activity) against one or more species of bacteria other than A. baumannii, E. faecalis, E. faecium or S. aureus (e.g., P. aeruginosa). In certain embodiments, the polypeptide of the invention comprises or consists of the amino acid sequence SEQ ID NO:68, SEQ ID NO:184, SEQ ID NO:202 or SEQ ID NO:203, or a fragment, variant or derivative thereof, which polypeptide exhibits antibacterial or antimicrobial activity against E. faecalis or E. faecium. In other embodiments, the polypeptide of the invention comprises or consists of the amino acid sequence SEQ ID NO:446, SEQ ID NO:447, SEQ ID NO:448, SEQ ID NO:575, SEQ ID NO:641 or SEQ ID NO:712, or a fragment, variant or derivative thereof, which polypeptide exhibits antibacterial or antimicrobial activity against S. aureus. In yet still other embodiments, the polypeptide of the invention comprises or consists of the amino acid sequence SEQ ID NO:797, or a fragment, variant or derivative thereof, which polypeptide exhibits antibacterial or antimicrobial activity against A. baumanni.

In certain embodiments, the polypeptide of the invention comprises or consists of a CHAP domain isolated from an endolysin or lysin of bacteriophage F168/08, F170/08, F770/05, F197/08, F86/06, F87s/06 or F91a/06. Isolated CHAP domains have been demonstrated to retain the antibacterial activity, e.g., lytic killing activity, of the endolysin or lysin from which they are derived; CHAP domains may be identified and isolated by methods routine in the art (see, e.g., Rigden et al., 2003, Trends Biochem. Sci. 28:230-234; Bateman et al., 2003, Trends Biochem. Sci. 28:234-237, each of which is incorporated by reference herein in its entirety). In specific embodiments, the polypeptide of the invention comprises or consists of a CHAP domain isolated from a polypeptide having an amino acid sequence of SEQ ID NO:68, SEQ ID NO:184, SEQ ID NO:202, SEQ ID NO:203, SEQ ID NO:446, SEQ ID NO:447, SEQ ID NO:448, SEQ ID NO:575, SEQ ID NO:641 or SEQ ID NO:712. In specific embodiments, the invention provides for an isolated polypeptide that comprises or consists of the CHAP domain derived from a second polypeptide having the amino acid sequence of SEQ ID NO:68, SEQ ID NO:446, SEQ ID NO:575, SEQ ID NO:641 or SEQ ID NO:712, wherein the CHAP domain has the amino acid sequence of SEQ ID NO:755, SEQ ID NO:756, SEQ ID NO:757, SEQ ID NO:758 or SEQ ID NO:759, respectively. That is, SEQ ID NO:755 corresponds to a CHAP domain derived from the polypeptide having amino acid sequence of SEQ ID NO:68; SEQ ID NO:756 corresponds to a CHAP domain derived from the polypeptide having amino acid sequence of SEQ ID NO:446, and so forth. In other embodiments the invention provides for a fragment, variant or derivative of a CHAP domain of isolated from an endolysin or lysin of bacteriophage F168/08, F170/08, F770/05, F197/08, F86/06, F87s/06 or F91a/06, which fragment, variant or derivative exhibits at least one biological activity, e.g., lytic cell killing, of the CHAP domain from which it was derived and wherein said CHAP domain has an amino acid sequence of SEQ ID NO:755, SEQ ID NO:756, SEQ ID NO:757, SEQ ID NO:758 or SEQ ID NO:759. The amino acid sequences of SEQ ID NO:755-SEQ ID NO:759 are provided in Table 1.

TABLE 1

Amino acid sequences of CHAP domains isolated from bacteriophages of the invention

| SEQ ID NO | Sequence | Phage |
|---|---|---|
| 755 | NGLVGKGVDADGWYGTQCMDLTVDVMQRFFGWRPYGNAIALV DQPIPAGFQRIRTTSSTQIKAGDVMIWGLGYYAQYGHTGIATEDG RADGTFVSVDQNWINPSLEVGSPAAAIHHNMDGVWGVIR | F168/08 |
| 756 | DNSLGKQFNPDLFYGFQCYDYANMFFMIATGERLQGLYAYNIPF DNKARIEKYGQIIKNYDSFLPQKLDIVVFPSKYGGGAGHVEIVESA NLNTFTSYGQNWNGKGWTNGVAQPGWGPETVTRHVHYYDDPM YFIR | F197/08 |
| 757 | RWYQGRYIDFDGWYGYQCADLAVDYIYWLLEIRMWGNAKDAI NNDFKNMATVYENTPSFVPQIGDVAVFTKGIYKQYGHIGLVFNG GNTNQFLILEQNYDGNANTPAKLRWDNYYGCTHFIR | F86/06 |
| 758 | RWYQGRYIDFDGWYGYQCADLAVDYIYWLLEIRMWGNAKDAI NNDFKNMATVYENTPSFVPQIGDVAVFTKGIYKQYGHIGLVFNG GNTNQFLILEQNYDGNANTPAKLRWDNYYGCTHFIR | F87s/06 |
| 759 | RWYQGRYIDFDGWYGYQCADLAVDYIYWLLEIRMWGNAKDAI NNDFKNMATVYENTPSFVPQIGDVAVFTKGIYKQYGHIGLVFNG GNTNQFLILEQNYDGNANTPAKLRWDNYYGCTHFIR | F91a/06 |

In certain embodiments, a polypeptide of the invention comprises or consists of a tail length tape measure protein or tail protein (e.g., tail component, tail fiber protein, adsorption associated tail protein), or fragment thereof, isolated from a bacteriophage having a genome comprising or consisting of SEQ ID NO:1, SEQ ID NO:2, SEQ ID NO:3, SEQ ID NO:4, SEQ ID NO:5, SEQ ID NO:6, SEQ ID NO:7, or SEQ ID NO:760 (e.g., bacteriophage F168/08, F170/08, F770/05, F197/08, F86/06, F87s/06, F91a/06, or F1245/05, respectively), wherein the tail length tape measure protein or tail protein, or fragment thereof has a biologic function associated with the bacteriophage from which it is derived, e.g., antimicrobial or antibacterial activity (e.g., lytic killing activity). In specific embodiments, the antimicrobial or antibacterial activity of the tail length tape measure protein or tail protein is directed against at least one or more species or strains of *A. baumannii, E. faecalis, E. faecium, P. aeruginosa* and/or *S. aureus*. In specific embodiments, the polypeptide of the invention is a tail tape measure protein or tail protein having the amino acid sequence comprising or consisting of SEQ ID NO:61, SEQ ID NO:63, SEQ ID NO:204, SEQ ID NO:214, SEQ ID NO:435, SEQ ID NO:438, SEQ ID NO:440, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:567, SEQ ID NO:568, SEQ ID NO:632, SEQ ID NO:633, SEQ ID NO:700, SEQ ID NO:701, SEQ ID NO:702, SEQ ID NO:703, SEQ ID NO:704, or SEQ ID NO:795. In other embodiments, the isolated polypeptide of the invention is a fragment, variant or derivative of the amino acid sequence of SEQ ID NO:61, SEQ ID NO:63, SEQ ID NO:204, SEQ ID NO:214, SEQ ID NO:435, SEQ ID NO:438, SEQ ID NO:440, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:567, SEQ ID NO:568, SEQ ID NO:632, SEQ ID NO:633, SEQ ID NO:700, SEQ ID NO:701, SEQ ID NO:702, SEQ ID NO:703, SEQ ID NO:704, or SEQ ID NO:795, which fragment variant or derivative exhibits at least one biological activity or function of the bacteriophage from which it is isolated or derived, e.g., antimicrobial or antibacterial activity (e.g., lytic killing activity). In preferred embodiments, the at least one biological activity or function of the fragment, variant or derivative is directed against one or more strains of *E. faecalis, E. faecium, P. aeruginosa, S. aureus*, and/or *A. baumannii*.

In certain embodiments, the isolated polypeptide of the invention is a variant of a bacteriophage polypeptide, which variant comprises or consists of a amino acid sequence having at least 60%, 65%, 70%, 75%, 80%, 85%, 86%, 87%, 88%, 89%, 90%, 91%, 92%, 93%, 94%, 95%, 96%, 97%, 98%, 99%, or greater sequence identity to a second amino acid sequence of the same length (i.e., consisting of the same number of residues), which second amino acid sequence is SEQ ID NO:61, SEQ ID NO:63, SEQ ID NO:68, SEQ ID NO:184, SEQ ID NO:202, SEQ ID NO:203, SEQ ID NO:204, SEQ ID NO:214, SEQ ID NO:435, SEQ ID NO:438, SEQ ID NO:440, SEQ ID NO:446, SEQ ID NO:447, SEQ ID NO:448, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:567, SEQ ID NO:568, SEQ ID NO:575, SEQ ID NO:632, SEQ ID NO:633, SEQ ID NO:641, SEQ ID NO:700, SEQ ID NO:701, SEQ ID NO:702, SEQ ID NO:703, SEQ ID NO:704, SEQ ID NO:712, SEQ ID NO:755, SEQ ID NO:756, SEQ ID NO:757, SEQ ID NO:758, SEQ ID NO:759, SEQ ID NO:795, or SEQ ID NO:797, and/or a fragment thereof, and wherein the variant exhibits at least one biological function or activity of the bacteriophage from which it was derived (e.g., antimicrobial or antibacterial activity (e.g., lytic killing activity)) against one or more strains of bacteria (e.g., Gram-positive bacteria (e.g., *E. faecalis, E. faecium, S. aureus*), Gram-negative bacteria (e.g., *P. aeruginosa, A baumannii*) or bacteria not classified as either Gram-positive or Gram-negative).

In certain embodiments, the invention provides an isolated polypeptide having an amino acid sequence of any of SEQ ID NOS:2-124, SEQ ID NOS: 126-338, SEQ ID NOS:340-434, SEQ ID NOS:436-550, SEQ ID NOS:552-614, SEQ ID NOS:616-680, SEQ ID NOS:682-759, SEQ ID NOS:761-816, and active biologic fragments thereof. In preferred embodiments, the variant polypeptide of the invention exhibits at least one biologic activity associated with the polypeptide or bacteriophage from which it was isolated or derived directed against at least one or more strains of *E. faecalis, E. faecium, P. aeruginosa, S. aureus*, and/or *A. baumannii*.

In other embodiments, the invention provides an isolated nucleic acid sequence encoding the amino acid sequence of one of SEQ ID NOS:8-130, SEQ ID NOS:131-343, SEQ ID NOS:344-438, SEQ ID NOS:439-553, SEQ ID NOS:554-616, SEQ ID NOS:617-681, SEQ ID NOS:682-759, SEQ ID NOS:761-816, and active fragments thereof. In other embodiments the invention provides the nucleic acid sequence of any of the open reading frames identified in FIGS. 2, 5, 8, 11, 14, 17, 20, and 23.

In certain embodiments, the polypeptides of the present invention are recombinantly fused or chemically conjugated (including both covalently and non-covalently conjugations) to therapeutic agents, e.g., heterologous polypeptides or small molecules, to generate fusion proteins or chimeric polypeptides. The fusion does not necessarily need to be direct, but may occur through linker sequences or through chemical conjugation. Non-limiting examples of therapeutic agents to which the polypeptides of the invention may be conjugated are peptide or non-peptide cytotoxins (including antimicrobials and/or antibiotics), tracer/marker molecules (e.g., radionuclides and fluorphores) and other antibiotic or antibacterial compounds known in the art.

6.1 Antibiotic Compositions

The isolated bacteriophages or polypeptides of the present invention may be administered alone or incorporated into a pharmaceutical composition for the use in treatment or prophylaxis of bacterial infections, e.g., infections caused by bacteria including, but not limited to, *A. baumannii, E. faecalis, E, faecium, P. aeruginosa* and *S. aureus*. The polypeptides may be combined with a pharmaceutically acceptable carrier, excipient, or stabilizer. Examples of pharmaceutically acceptable carriers, excipients and stabilizers include, but are not limited to, buffers such as phosphate, citrate, and other organic acids; antioxidants including ascorbic acid; low molecular weight polypeptides; proteins, such as serum albumin and gelatin; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLURONICS™. The pharmaceutical composition of the present invention (e.g., antibacterial composition) can also include a lubricant, a wetting agent, a sweetener, a flavoring agent, an emulsifier, a suspending agent, and a preservative, in addition to the above ingredients.

The bacteriophages and/or polypeptides of the present invention may also be combined with one or more therapeutic and or prophylactic agents useful for the treatment of bacterial infection as described herein and/or known in the art (e.g. one or more lysins). The pharmaceutical compositions of the invention may therefore comprise two or more isolated bacteriophages of the invention (with antibacterial activity against the same or different bacterial species or strains), the combination of a bacteriophage and a polypeptide of the invention or the combination of a bacteriophage and/or polypeptide of the invention and a bacteriophage and/or therapeutic polypeptide known in the art. In specific embodiments, the therapeutic components of a combination target two or more species or strains of bacteria or exhibit differing enzymatic activity. For example, lysins, in general, exhibit one of amidase, endopeptidase, muramidase or glucosamidase activity. Accordingly, the combination of lysins exhibiting different activities may provide synergistic enhancement to the therapeutic activity of the pharmaceutical composition of the invention.

Examples of other therapeutic agents that may be used in combination with the polypeptide of the invention include, but are not limited to, standard antibiotic agents, anti-inflammatory agents, antiviral agents, local anesthetic agents, and corticosteroids.

Standard antibiotics that maybe used with pharmaceutical compositions comprising polypeptides of the invention include, but are not limited to, amikacin, gentamicin, kanamycin, neomycin, netilmicin, paromomycin, rhodostreptomycin, streptomycin, tobramycin, apramycin, rifamycin, naphthomycin, mupirocin, geldanamycin, ansamitocin, carbacephems, imipenem, meropenem, ertapenem, faropenem, doripenem, panipenem/betamipron, biapenem, PZ-601, cephalosporins, cefacetrile, cefadroxil, cefalexin, cefaloglycin, cefalonium, cefaloridine, cefalotin, cefapirin, cefatrizine, cefazaflur, cefazedone, cefazolin, cefradine, cefroxadine, ceftezole, cefaclor, cefonicid, cefprozil, cefuroxime, cefuzonam, cefinetazole, cefotetan, cefoxitin, cefcapene, cefdaloxime, cefdinir, cefditoren, cefetamet, cefixime, cefmenoxime, cefteram, ceftibuten, ceftiofur, ceftiolene, ceftizoxime, ceftriaxone, cefoperazone, ceftazidime latamoxef, cefclidine, cefepime, cefluprenam, cefoselis, cefozopran, cefpirome, cefquinome, flomoxef, ceftobiprole, azithromycin, clarithromycin, dirithromycin, erythromycin, roxithromycin, aztreonam, pencillin and penicillin derivatives, actinomycin, bacitracin, colistin, polymyxin B, cinoxacin, flumequine, nalidixic acid, oxolinic acid, piromidic acid, pipemidic acid, rosoxacin, ciprofloxacin, enoxacin, fleroxacin, lomefloxacin, nadifloxacin, norfloxacin, ofloxacin, pefloxacin, rufloxacin, balofloxacin, gatifloxacin, grepafloxacin, levofloxacin, moxifloxacin, pazufloxacin, sparfloxacin, temafloxacin, tosufloxacin, clinafloxacin, garenoxacin, gemifloxacin, stifloxacin, trovalfloxacin, prulifloxacin, acetazolamide, benzolamide, bumetanide, celecoxib, chlorthalidone, clopamide, dichlorphenamide, dorzolamide, ethoxyzolamide, furosemide, hydrochlorothiazide, indapamide, mafendide, mefruside, metolazone, probenecid, sulfacetamide, sulfadimethoxine, sulfadoxine, sulfanilamides, sulfamethoxazole, sulfasalazine, sultiame, sumatriptan, xipamide, tetracycline, chlortetracycline, oxytetracycline, doXycycline, lymecycline, meclocycline, methacycline, minocycline, rolitetracycline and any combination thereof in amounts that are effective to additively or synergistically enhance the therapeutic effect of the bacteriophage or polypeptide of the invention for a given infection.

Local anesthetics that may be used in pharmaceutical compositions of the present invention include tetracaine, tetracaine hydrochloride, lidocain, lidocaine hydrochloride, dimethisoquin hydrochloride, dibucaine, dibucaine hydrochloride, butambenpicrate, and pramoxine hydrochloride. An exemplary concentration of local anesthetic is about 0.025% to about 5% by weight of the total composition.

Corticosteroids that may be useful in combination with the polypeptides, phage, and/or pharmaceutical compositions of the invention include betamethasone, dipropionate, fluocinolone, actinide, betamethasone valerate, triamcinolone actinide, clobetasol propionate, desoximetasone, diflorasone diacetate, amcinonide, flurandrenolide, hydrocortisone valerate, hydrocortisone butyrate, and desonide. An exemplary concentration of corticosteroid is about 0.01% to about 1% by weight of the total composition.

In certain embodiments, a formulation comprising a bacteriophage and/or polypeptide of the invention further comprises SM buffer (0.05 M Tris-HCl (pH 7.4-7.5); 0.1 M NaCl; 10 mM MgSO$_4$). In other embodiments, the formulation further comprises SM buffer and 10 mM MgCl$_2$. In still other embodiments, the formulation further comprises SM buffer and about 20% or about 30% ethanol.

Pharmaceutical compositions comprising a bacteriophage and/or polypeptide of the present invention can be formulated in a unit dose or multi-dose formulation. Suitable formulations can be selected from the group consisting of ointments, solutions, suspensions or emulsions, extracts, powders, granules, sprays, lozenges, tablets or capsules and additionally include a dispersing agent or a stabilizing agent.

The pharmaceutical compositions of the invention can be administered by inhalation, in the form of a suppository or pessary, topically (e.g., in the form of a lotion, solution, cream, ointment or dusting powder), epi- or transdermally (e.g., by use of a skin patch), orally (e.g., as a tablet, which may contain excipients such as starch or lactose), as a capsule, ovule, elixirs, solutions or suspensions (each optionally containing flavoring, coloring agents and/or excipients), or they can be injected parenterally (e.g., intravenously, intramuscularly or subcutaneously). For parenteral administration, the compositions may be best used in the form of a sterile aqueous solution which may contain other substances, for example enough salts or monosaccharides to make the solution isotonic with blood. For buccal or sublingual administration the compositions may be administered in the form of tablets or lozenges which can be formulated in a conventional manner. In a preferred embodiment, a bacteriophage and/or polypeptide of the present invention is administered topically, either as a single agent, or in combination with other antibiotic treatments as described herein or known in the art.

A bacteriophage and/or polypeptide of the present invention may also be dermally or transdermally administered. For topical application to the skin, the bacteriophages and/or polypeptides of the present invention may be combined with one, or a combination of carriers, which include but are not limited to, an aqueous liquid, an alcohol base liquid, a water soluble gel, a lotion, an ointment, a nonaqueous liquid base, a mineral oil base, a blend of mineral oil and petrolatum, lanolin, liposomes, proteins carriers such as serum albumin or gelatin, powdered cellulose carmel, and combination thereof. A topical mode of delivery may include a smear, a spray, a time-release patch, a liquid absorbed wipe, and combinations thereof. The bacteriophage and/or polypeptide of the invention may be applied to a patch or bandage either directly or in one of the carriers. The patches may be damp or dry, wherein the phage and/or polypeptide (e.g., a lysin) is in a lyophilized form on the patch. The carriers of topical compositions may comprise semi-solid and gel-like vehicles that include a polymer thickener, water, preservatives, active surfactants, or emulsifiers, antioxidants, sun screens, and a solvent or mixed solvent system. U.S. Pat. No. 5,863,560 discloses a number of different carrier combinations that can aid in the exposure of skin to a medicament, and its contents are incorporated herein.

For intranasal or administration by inhalation, the bacteriophage and/or polypeptide of the invention is conveniently delivered in the form of a dry powder inhaler or an aerosol spray presentation from a pressurized container, pump, spray or nebuliser with the use of a suitable propellant, e.g. dichlorodifluoromethane, trichlorofluoromethane, dichlorotetrafluoroethane, a hydrofluoroalkane such as 1,1,1,2-tetrafluoroethane (HFA 134A.™.) or 1,1,1,2,3,3,3-heptafluoropropane (HFA 227EA.™.), carbon dioxide or other suitable gas. In the case of a pressurized aerosol, the dosage unit may be determined by providing a valve to deliver a metered amount. The pressurized container, pump, spray or nebuliser may contain a solution or suspension of the active compound, e.g. using a mixture of ethanol and the propellant as the solvent, which may additionally contain a lubricant, e.g. sorbitan trioleate. Capsules and cartridges (made, for example, from gelatin) for use in an inhaler or insufflator may be formulated to contain a powder mix of the bacteriophage and/or polypeptide of the invention and a suitable powder base such as lactose or starch.

For administration in the form of a suppository or pessary, the therapeutic compositions may be applied topically in the form of a gel, hydrogel, lotion, solution, cream, ointment or dusting powder. Compositions of the invention may also be administered by the ocular route. For ophthalmic use, the compositions of the invention can be formulated as micronized suspensions in isotonic, pH adjusted, sterile saline, or, preferably, as solutions in isotonic, pH adjusted, sterile saline, optionally in combination with a preservative such as a benzylalkonium chloride. Alternatively, they may be formulated in an ointment such as petrolatum.

Dosages and desired drug concentrations of the pharmaceutical compositions of the present invention may vary depending on the particular use. The determination of the appropriate dosage or route of administration is well within the skill of an ordinary physician. Animal experiments can provide reliable guidance for the determination of effective doses in human therapy. Interspecies scaling of effective doses can be performed by one of ordinary skill in the art following the principles described by Mordenti, J. and Chappell, W. "The use of interspecies scaling in toxicokinetics" in Toxicokinetics and New Drug Development, Yacobi et al., Eds., Pergamon Press, New York 1989, pp 42-96.

6.2 Therapeutic Use

The bacteriophages and polypeptides of the present invention have activity against a plurality of strains of *E. faecalis, E. faecium, P. aeruginosa, S. aureus*, and/or *A. baumannii*-, as described in FIGS. 3A-B, 6A-B, 9, 12, 15, 18, 21, and 23. Therefore, the compositions of the present invention may used in methods of preventing and treating infections associated with *E. faecalis, E. faecium, P. aeruginosa, S. aureus*, and/or *A. baumannii* in both humans and animals. In other embodiments, the compositions of the present invention may be used to treat infection associated with related species or strains of these bacteria, including, but not limited to *S. epidermidis, S. auricularis, S. capitis, S. haemolyticus, S. hominis, S. saprophyticus, S. simulans, S. xylosis, Micrococcus luteus, Bacilus subtilis, B. pumilus, E. hirae*, and/or one or more of the strains of *A. baumannii*, e.g, one or more of the strains described in FIG. 24.

In specific embodiments, the subject receiving a pharmaceutical composition of the invention is a mammal (e.g., bovine, ovine, caprine, equid, primate (e.g., human), rodent, lagomorph or avian (e.g., chicken, duck, goose)). In the context of the present invention, "treatment" refers to therapeutic treatment and wherein the object is to eliminate, lessen, decrease the severity of, ameliorate, slow the progression of or prevent the symptoms or underlying cause (e.g., bacterial infection) associated with the pathological condition or disorder. "Treatment" refers to both therapeutic treatment and prophylactic or preventative measures, wherein the object is to eliminate, lessen, decrease the severity of, slow the progression of or delay or prevent the symptoms or underlying cause (e.g., bacterial infection) associated with the pathological condition or disorder. It is also contemplated that a bacteriophage and/or polypeptide of the invention acts as a prophylactic or preventative measure, preventing the onset of infection caused by one or more bacteria.

*A. baumannii, E. faecalis, E. faecium, P. aeruginosa* and *S. aureus* are responsible for many severe opportunistic infections, particularly in individuals with compromised immune systems. The pharmaceutical compositions of the present invention are contemplated for treating any infection associated with *A. baumannii, E. faecalis, E. faecium, P. aeruginosa* or *S. aureus*, or associated with other species or strains of bacteria, including, but not limited to, infections of the skin (including but not limited to skin ulcers, bed sores and diabetic foot ulcers), infections in and around wounds, post-operative infections, infections associated with catheters and surgical drains and infections of the blood.

*A. baumannii, E. faecalis, E. faecium, P. aeruginosa* and *S. aureus* are also associated with infections that involve organ systems that have a high fluid content, and it is contemplated that the bacteriophages and/or polypeptides of the invention have therapeutic use in the prevention and treatment of these infections. For example, the pharmaceutical compositions of the invention may be used for the prevention or treatment of infections of the respiratory tract, of the cerebrospinal fluid, of peritoneal fluid, and of the urinary tract. The compositions of the invention may also be used to prevent and/or treat nosocomial pneumonia, infections associated with continuous ambulatory peritoneal dialysis (CAPD), catheter-associated bacteruria, and nosocomial meningitis.

In a preferred embodiment, a bacteriophage and/or polypeptide of the invention is used prophylactically in hospital setting, particularly to prevent infections associated with wounds, ulcers, and openings in the skin due to catheterization, and any other medical procedures or devices.

In certain embodiments, a bacteriophage and/or polypeptide of the invention is used as a single agent for treating or preventing infections associated with *A. baumannii, E. faecalis, E. faecium, P. aeruginosa, S. aureus* or other bacterial species. In other embodiments of the invention, a bacteriophage and/or polypeptide of the invention is used in combination with other agents, including other bacteriophages (for example, that target a different species or strain of bacteria), or with antibiotics that target the same or different kinds of bacteria, including bacteria selected from any gram-positive bacteria, any gram-negative bacteria, and any other groups of bacteria that is not classified as gram-positive or gram-negative. The compositions of the invention may also be used in combination with any other means of treating bacterial infection known to one of skill in the art.

Also contemplated by the invention are methods of preventing and methods of treating an infection caused by bacteria including, but not limited to, *E. faecalis, E. faecium, P. aeruginosa, S. aureus*, and/or *A. baumannii*, comprising administering to a mammal in need thereof a composition comprising a lysin comprising or consisting of the amino acid sequence of SEQ ID NO:68, SEQ ID NO:184, SEQ ID NO:202, SEQ ID NO:203, SEQ ID NO:446, SEQ ID NO:447, SEQ ID NO:448, SEQ ID NO:575, SEQ ID NO:641, I.D. NO:712, and/or SEQ ID NO:797, or a fragment, variant or derivative thereof, wherein the fragment, variant or derivative exhibits antibacterial or antimicrobial activity against the species of bacteria from which the parent bacteriophage was isolated. In a specific example in accordance with this embodiment, the invention provides methods of preventing or treating an infection caused by a bacteria including, but not limited to, *E. faecalis, E. faecium, P. aeruginosa, S. aureus*, and/or *A. baumannii*, comprising administering to a mammal in need thereof a composition comprising an isolated CHAP domain of a lysin, or a fragment, variant or derivative thereof that exhibits at least one biologic activity of the CHAP domain from which it was isolated (e.g., lytic cell killing). In certain embodiments, the isolated CHAP domain comprises or consists of the amino acid sequence of SEQ ID NO:755, SEQ ID NO:756, SEQ ID NO:757, SEQ ID NO:758 or SEQ ID NO:759. In other embodiments, the invention provides methods of preventing and treating an infection caused by bacteria including, but not limited to, *E. faecalis, E. faecium, P. aeruginosa, S. aureus*, and/or *A. baumannii*, comprising administering to a mammal in need thereof a composition comprising a tail tape measure protein or tail protein comprising or consisting of the amino acid sequence of SEQ ID NO:61, SEQ ID NO:63, SEQ ID NO:204, SEQ ID NO:214, SEQ ID NO:435, SEQ ID NO:438, SEQ ID NO:440, SEQ ID NO:525, SEQ ID NO:526, SEQ ID NO:527, SEQ ID NO:528, SEQ ID NO:529, SEQ ID NO:530, SEQ ID NO:531, SEQ ID NO:532, SEQ ID NO:533, SEQ ID NO:534, SEQ ID NO:535, SEQ ID NO:536, SEQ ID NO:537, SEQ ID NO:538, SEQ ID NO:539, SEQ ID NO:567, SEQ ID NO:568, SEQ ID NO:632, SEQ ID NO:633, SEQ ID NO:700, SEQ ID NO:701, SEQ ID NO:702, SEQ ID NO:703, SEQ ID NO:704, and/or SEQ ID NO:795, or a fragment, variant or derivative thereof, wherein the fragment, variant or derivative exhibits a biologic activity associated with the parent bacteriophage. In still other embodiments, the invention provides methods of preventing and treating an infection caused by bacteria including, but not limited to, *E. faecalis, E. faecium, P. aeruginosa, S. aureus*, and/or *A. baumannii*, comprising administering to a mammal in need thereof a composition comprising bacteriophage having a genome comprising or consisting of the nucleic acid sequence of SEQ ID NO:1, SEQ ID NO:2, SEQ ID NO:3, SEQ ID NO:4, SEQ ID NO:5, SEQ ID NO:6, SEQ ID NO:7, and/or SEQ ID NO:760. Combinations of the lysins (or fragments, variants or derivatives thereof as described above) and of tail tape measure proteins or tail proteins (or fragments, variants or derivatives thereof as described above), optionally with one or more bacteriophages of the invention or with other treatments, such as antibiotics, are also contemplated, as well as methods of treating and methods of preventing a bacterial infection using one or more of the combinations herein described.

As used herein, the term "in combination" refers to the use of more than one prophylactic and/or therapeutic agent. The use of the term "in combination" does not restrict the order in which prophylactic and/or therapeutic agents are administered to a subject with a disease or disorder. A first prophylactic or therapeutic agent can be administered prior to (e.g., 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks before), concomitantly with, or subsequent to (e.g., 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks after) the administration of a second prophylactic or therapeutic agent (different from the first prophylactic or therapeutic agent) to a subject with a disease or disorder.

6.3 Disinfectant and Anti-Infective Use

Bacterial pathogens most often infect at a mucous membrane site (e.g., upper and lower respiratory, intestinal, urogenital and ocular). The mucous membranes themselves are often the reservoir, sometimes the only reservoir, for many pathogenic bacteria found in the environment (e.g. *pneumococci, staphylococci* and *streptococci*). There are very few anti-infectives that are designed to control the carrier state of pathogenic bacteria. However, studies have shown that by reducing or eliminating this reservoir in environments such as hospitals and nursing homes, the incidence of infections by these bacteria will be markedly reduced.

The bacteriophages and/or polypeptides of the present invention may be used in anti-infective compositions for controlling the growth of bacteria (e.g., Gram-positive bacteria (e.g., *E. faecalis, E. faecium, S. aureus*), Gram-negative bacteria (e.g., *P. aeruginosa, A. baumannii*) or bacteria not classified as either Gram-positive or Gram-negative), in order to prevent or reduce the incidence of serious infections. In addition to use in compositions for application to mucous membranes, a bacteriophage and/or polypeptide of the present incorporation may also be incorporated into formulations such as gels, creams, ointments, or sprays for controlling or preventing colonization of bacteria on body surfaces (e.g., skin and mucus membranes) (e.g., for sterilization of surgical fields or of the hands and exposed skin of healthcare workers and/or patients) and other solid surfaces (e.g., appliances, countertops and, in particular, hospital equipment).

6.4 Diagnostic Methods

The present invention also encompasses diagnostic methods for determining the causative agent in a bacterial infection. In certain embodiments, the diagnosis of the causative agent in a presentation of bacterial infection is performed by (i) culturing tissue, blood or fluid samples of a patient according to standard techniques, (ii) contacting the culture with one or more bacteriophages and/or polypeptides of the invention and (iii) monitoring cell growth and evidence of lysis after said contacting. Because the activity of bacteriophages and/or their isolated products (e.g., polypeptides, or biologically active fragments, variants or derivatives thereof) tends to be species or strain specific, susceptibility, or lack of susceptibility, to one or more bacteriophages and/or polypeptides of the invention may be indicative of the species or strain of infective bacteria. For example, decreased growth of test cultures after contacting with a bacteriophage having a genome comprising or consisting of the nucleic acid sequence SEQ ID NO:1 or SEQ ID NO:2, or with an isolated polypeptide product thereof, may be indicative of the test sample comprising *E. faecalis* or *E. faecium*. Similarly, a bacteriophage having a genome comprising or consisting of the nucleic acid sequence SEQ ID NO:3, or an isolated polypeptide product thereof, may be used to identify infection by *P. aeruginosa*; a bacteriophage having a genome comprising or consisting of the nucleic acid sequence SEQ ID NO:760, or an isolated polypeptide product thereof, may be used to identify infection by *A. baumannii*, while that having a genome comprising or consisting of the nucleic acid sequence SEQ ID NO:4, SEQ ID NO:5, SEQ ID NO:6 or SEQ ID NO:7, or an isolated polypeptide product thereof, may be used to identify infection by *S. aureus*.

6.5 Amino Acid Variants

Amino acid sequence variants of the polypeptides of the invention can be created such that they are substitutional, insertional or deletion variants. Deletion variants lack one or more residues of the native protein which are not essential for function (e.g., antimicrobial or antibacterial activity). Insertional mutants typically involve the addition of material at a non-terminal point in the polypeptide. Substitutional variants typically contain the exchange of one amino acid for another at one or more sites within the protein, and may be designed to modulate one or more properties of the polypeptide, such as stability against proteolytic cleavage, without the loss of other functions or properties. Substitutions of this kind preferably are conservative, that is, one amino acid is replaced with one of similar shape and charge. Conservative substitutions are well known in the art and include, for example, the changes of: alanine to serine; arginine to lysine; asparagine to glutamine or histidine; aspartate to glutamate; cysteine to serine; glutamine to asparagine; glutamate to aspartate; glycine to proline; histidine to asparagine or glutamine; isoleucine to leucine or valine; leucine to valine or isoleucine; lysine to arginine; methionine to leucine or isoleucine; phenylalanine to tyrosine, leucine or methionine; serine to threonine; threonine to serine; tryptophan to tyrosine; tyrosine to tryptophan or phenylalanine; and valine to isoleucine or leucine.

Once general areas of the gene are identified as encoding the particular lysin protein as described herein, point mutagenesis may be employed to identify with particularity which amino acid residues are important in the antibacterial activities. Thus, one of skill in the art will be able to generate single base changes in the DNA strand to result in an altered codon and a missense mutation.

Preferably, mutation of the amino acids of a protein creates an equivalent, or even an improved, second-generation molecule. For example, certain amino acids may be substituted for other amino acids in a protein structure without detectable loss of function (e.g., antibacterial or antimicrobial activity). In making such changes, the hydropathic index of amino acids may be considered. The importance of the hydropathic amino acid index in conferring interactive biologic function on a protein is generally understood in the art. It is accepted that the relative hydropathic character of the amino acid contributes to the secondary structure of the resultant protein, which in turn defines the interaction of the protein with other molecules, for example, interaction with a peptidoglycan within the outer coat of a gram-positive bacteria. Each amino acid has been assigned a hydropathic index on the basis of their hydrophobicity and charge characteristics; for example: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan 0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

It is also understood in the art that the substitution of like amino acids can be made effectively on the basis of hydrophilicity. Like hydrophobicity, values of hydrophilicity have been assigned to each amino acid: arginine (+3.0); lysine (+3.0); aspartate (+3.0+1); glutamate (+3.0+1); serine (+0.3); asparagine (+0.2); glutamine (+0.2); glycine (0); threonine (−0.4); proline (−0.5+1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). Equivalent molecules may be obtained by substitution of one amino acid for another where their hydrophilicity indices are within ±2, preferably ±1, or most preferably ±5 of each other. In certain embodiments, the invention encompasses isolated peptides that comprise 1, 2, 3, 4, 5, 6, 7, 8, 9, or 10 or more amino acid modifications (e.g., insertion, substitution, deletion, etc.) relative to an amino acid sequence disclosed herein. In preferred embodiments, the mutation(s) are made such that biological activity of the particular polypeptide is retained. For example, the present invention encompasses polypeptides isolated from bacteriophage F1245/05, F168/08, F170/08, F770/05, F197/08, F86/06, F87s/06 and/or F91a/06, which are mutated to comprise 1, 2, 3, 4, 5, 6, 7, 8, 9, or 10 or more amino acid modifications relative to an amino acid sequence listed herein, and which exhibit antibacterial activity against one or more species or strains of Gram-positive or Gram-negative bacterium, e.g., *A. baumannii, E. faecalis, E. faecium, P. aeruginosa* and/or *S. aureus*. In specific embodiments, the polypeptides of the invention derived from F168/08 or F/170/08 exhibit antibacterial or antimicrobial activity, e.g., lytic killing activity, against at least *E. faecalis* and/or *E. faecium*; those derived from F770/05 against at least *P. aeruginosa*; those derived from F197/08, F86/06, F87s/06 or F91a/06 against at least *S. aureus*; and those derived from F1245/05 against at least *A. baumannii*.

6.6 Polynucleotides Encoding Polypeptides of the Invention

The invention provides polynucleotides comprising a nucleotide sequence encoding a polypeptide of the invention. The invention also encompasses polynucleotides that hybridize under high stringency, intermediate or lower stringency hybridization conditions, e.g., as defined supra, to polynucleotides that encode a polypeptide of the invention and that encode modified polypeptides that have antibiotic and/or other biological activity.

The polynucleotides may be obtained, and the nucleotide sequence of the polynucleotides determined, by any method known in the art. For example, a polynucleotide encoding a polypeptide of the invention may be generated from nucleic acid from a suitable source (e.g., bacteriophage F1245/05, F168/08, F170/08, F770/05, F197/08, F197/08, F86/06, F87s/06 or F91a/06). Nucleotide sequences may be isolated from phage genomes by routine methods known in the art (see, e.g., Carlson, "Working with bacteriophages: common techniques and methodological approaches," In, Futter and Sulakvelidze (Eds) Bacteriophages: Biology and Applications, 5$^{th}$ ed. CRC Press (2005); incorporated herein by reference in its entirety). If a source containing a nucleic acid encoding a particular polypeptide is not available, but the amino acid sequence of the polypeptide of the invention is known, a nucleic acid encoding the polypeptide may be chemically synthesized and cloned into replicable cloning vectors using any method well known in the art.

Once the nucleotide sequence of the polypeptide of the invention is determined, the nucleotide sequence of the polypeptide may be manipulated using methods well known in the art for the manipulation of nucleotide sequences, e.g., recombinant DNA techniques, site directed mutagenesis, PCR, etc. (see, for example, the techniques described in Sambrook et al., 1990, Molecular Cloning, A Laboratory Manual, 2d Ed., Cold Spring Harbor Laboratory, Cold Spring Harbor, N.Y. and Ausubel et al., eds., 1998, Current Protocols in Molecular Biology, John Wiley & Sons, NY, which are both incorporated by reference herein in their entireties), to generate polypeptides having a different amino acid sequence, for example to create amino acid substitutions, deletions, and/or insertions.

In yet another embodiment of the invention, the following nucleotide sequences are provided: the nucleotide sequence from nucleotide 1 to nucleotide 85 of SEQ ID NO:760; the nucleotide sequence from nucleotide 87 to nucleotide 584 of SEQ ID NO:760; the nucleotide sequence from nucleotide 594 to nucleotide 767 of SEQ ID NO:760; the nucleotide sequence from nucleotide 724 to nucleotide 1035 of SEQ ID NO:760; the nucleotide sequence from nucleotide 1005 to nucleotide 1823 of SEQ ID NO:760; the nucleotide sequence from nucleotide 1816 to nucleotide 2130 of SEQ ID NO:760; the nucleotide sequence from nucleotide 2132 to nucleotide 2383 of SEQ ID NO:760; the nucleotide sequence from nucleotide 2383 to nucleotide 3690 of SEQ ID NO:760; the nucleotide sequence from nucleotide 3687 to 4469 of SEQ ID NO:760; the nucleotide sequence from nucleotide 4466 to nucleotide 5458 of SEQ ID NO:760; the nucleotide sequence from nucleotide 5632 to nucleotide 7956 of SEQ ID NO:760; the nucleotide sequence from nucleotide 8010 to nucleotide 8912 of SEQ ID NO:760; the nucleotide sequence from nucleotide 8915 to nucleotide 9262 of SEQ ID NO:760; the nucleotide sequence from nucleotide 9252 to nucleotide 10223 of SEQ ID NO:760; the nucleotide sequence from nucleotide 10213 to nucleotide 10782 of SEQ ID NO:760; the nucleotide sequence from nucleotide 10769 to nucleotide 11218 of SEQ ID NO:760; the nucleotide sequence from nucleotide 11202 to nucleotide 11420 of SEQ ID NO:760; the nucleotide sequence from nucleotide 11413 to nucleotide 12342 of SEQ ID NO:760; the nucleotide sequence from nucleotide 12339 to nucleotide 12515 of SEQ ID NO:760; the nucleotide sequence from nucleotide 12512 to nucleotide 13165 of SEQ ID NO:760; the nucleotide sequence from nucleotide 13170 to nucleotide 15599 of SEQ ID NO:760; the nucleotide sequence from nucleotide 15609 to nucleotide 15872 of SEQ ID NO:760; the nucleotide sequence from nucleotide 15979 to nucleotide 16173 of SEQ ID NO:760; the nucleotide sequence from nucleotide 16175 to nucleotide 16482 of SEQ ID NO:760; the nucleotide sequence from nucleotide 16494 to nucleotide 18059 of SEQ ID NO:760; the nucleotide sequence from nucleotide 18072 to nucleotide 18815 of SEQ ID NO:760; the nucleotide sequence from nucleotide 18857 to nucleotide 19879 of SEQ ID NO:760; the nucleotide sequence from nucleotide 19930 to nucleotide 20178 of SEQ ID NO:760; the nucleotide sequence from nucleotide 20180 to nucleotide 20545 of SEQ ID NO:760; the nucleotide sequence from nucleotide 20646 to nucleotide 21203 of SEQ ID NO:760; the nucleotide sequence from nucleotide 21212 to nucleotide 23506 of SEQ ID NO:760; the nucleotide sequence from nucleotide 23506 to nucleotide 24186 of SEQ ID NO:760; the nucleotide sequence from nucleotide 24201 to nucleotide 27068 of SEQ ID NO:760; the nucleotide sequence from nucleotide 27084 to nucleotide 30212 of SEQ ID NO:760; the nucleotide sequence from nucleotide 30214 to nucleotide 32505 of SEQ ID NO:760; the nucleotide sequence from nucleotide 32515 to nucleotide 32880 of SEQ ID NO:760; the nucleotide sequence from nucleotide 32873 to nucleotide 33460 of SEQ ID NO:760; the nucleotide sequence from nucleotide 33460 to nucleotide 33816 of SEQ ID NO:760; the nucleotide sequence from nucleotide 33825 to nucleotide 35777 of SEQ ID NO:760; the nucleotide sequence from nucleotide 35774 to nucleotide 35872 of SEQ ID NO:760; the nucleotide sequence from nucleotide 35869 to nucleotide 36027 of SEQ ID NO:760; the nucleotide sequence from nucleotide 36038 to nucleotide 36193 of SEQ ID NO:760; the nucleotide sequence from nucleotide 36916 to nucleotide 36788 of SEQ ID NO:760; the nucleotide sequence from nucleotide 37209 to nucleotide 37427 of SEQ ID NO:760; the nucleotide sequence from nucleotide 37868 to nucleotide 38386 of SEQ ID NO:760; the nucleotide sequence from nucleotide 38383 to nucleotide 38586 of SEQ ID NO:760; the nucleotide sequence from nucleotide 38912 to nucleotide 39406 of SEQ ID NO:760; the nucleotide sequence from nucleotide 39406 to nucleotide 39915 of SEQ ID NO:760; the nucleotide sequence from nucleotide 39917 to nucleotide 40021 of SEQ ID NO:760; the nucleotide sequence from nucleotide 40018 to nucleotide 40101 of SEQ ID NO:760; the nucleotide sequence from nucleotide 40101 to nucleotide 40670 of SEQ ID NO:760; the nucleotide sequence from nucleotide 40720 to nucleotide 41838 of SEQ ID NO:760; the nucleotide sequence from nucleotide 41822 to nucleotide 42127 of SEQ ID NO:760; the nucleotide sequence from nucleotide 42105 to nucleotide 42308 of SEQ ID NO:760; the nucleotide sequence from nucleotide 42382 to nucleotide 42912 of SEQ ID NO:760; and the nucleotide sequence from nucleotide 42896 to nucleotide 43015 of SEQ ID NO:760.

6.7 Recombinant Expression of Molecules of the Invention

Once a nucleic acid sequence encoding a molecule of the invention (e.g., a polypeptide) has been obtained, the vector for the production of the molecules may be produced by recombinant DNA technology using techniques well known in the art. Methods which are well known to those skilled in the art can be used to construct expression vectors containing the coding sequences for the molecules of the invention and appropriate transcriptional and translational control signals. These methods include, for example, in vitro recombinant DNA techniques, synthetic techniques, and in vivo genetic recombination. (See, for example, the techniques described in Sambrook et al., 1990, Molecular Cloning, A Laboratory Manual, 2d Ed., Cold Spring Harbor Laboratory, Cold Spring Harbor, N.Y. and Ausubel et al. eds., 1998, Current Protocols in Molecular Biology, John Wiley & Sons, NY).

The present invention provides expression vectors encoding the polypeptides of the invention. An expression vector comprising the nucleotide sequence of a molecule identified by the methods of the invention can be transferred to a host cell by conventional techniques (e.g., electroporation, liposomal transfection, and calcium phosphate precipitation) and the transfected cells are then cultured by conventional techniques to produce the molecules of the invention. In preferred embodiments, the host cell is other than the species of the parent bacteria from which the bacteriophage comprising the sequence was derived. In specific embodiments, the expression of the molecules of the invention is regulated by a constitutive, an inducible or a tissue, specific promoter. In specific embodiments the expression vector is pQE-30 (Qiagen) or pET-29(a) (Novagen).

The host cells used to express the molecules identified by the methods of the invention may be either bacterial cells (non susceptible to the bacteriophage protein or fragment thereof of the invention) such as *Escherichia coli*. A variety of host-expression vector systems may be utilized to express the molecules identified by the methods of the invention. Such host-expression systems represent vehicles by which the coding sequences of the molecules of the invention may be produced and subsequently purified, but also represent cells which may, when transformed or transfected with the appropriate nucleotide coding sequences, express the molecules of the invention in situ. These include, but are not limited to, microorganisms such as bacteria that are not susceptible to the bacteriophage protein or fragment thereof of the invention (e.g., *E. coli* and *B. subtilis*) transformed with recombinant bacteriophage DNA, plasmid DNA or cosmid DNA expression vectors containing coding sequences for the molecules identified by the methods of the invention; yeast (e.g., *Saccharomyces pichia*) transformed with recombinant yeast expression vectors containing sequences encoding the molecules identified by the methods of the invention; insect cell systems infected with recombinant virus expression vectors (e.g., baculovirus) containing the sequences encoding the molecules identified by the methods of the invention; plant cell systems infected with recombinant virus expression vectors (e.g., cauliflower mosaic virus (CaMV) and tobacco mosaic virus (TMV) or transformed with recombinant plasmid expression vectors (e.g., Ti plasmid) containing sequences encoding the molecules identified by the methods of the invention; or mammalian cell systems (e.g., COS, CHO, BHI, 293, 293T, 3T3 cells, lymphotic cells (see U.S. Pat. No. 5,807,715), Per C.6 cells (human retinal cells developed by Crucell) harboring recombinant expression constructs containing promoters derived from the genome of mammalian cells (e.g., metallothionein promoter) or from mammalian viruses (e.g., the adenovirus late promoter; the vaccinia virus 7.5K promoter).

In bacterial systems not susceptible to the bacteriophage protein or fragment of the invention, a number of expression vectors may be advantageously selected depending upon the use intended for the molecule being expressed. For example, when a large quantity of such a protein is to be produced, for the generation of pharmaceutical compositions of a polypeptide, vectors which direct the expression of high levels of fusion protein products that are readily purified may be desirable. Such vectors include, but are not limited, to the *E. coli* expression vector pUR278 (Ruther et al., 1983, *EMBO J.* 2:1791), in which the protein sequence may be ligated individually into the vector in frame with the lac Z coding region so that a fusion protein is produced; pIN vectors (Inouye & Inouye, 1985, *Nucleic Acids Res.* 13:3101-3109; Van Heeke & Schuster, 1989, *J. Biol. Chem.* 24:5503-5509); and the like. pGEX vectors may also be used to express foreign polypeptides as fusion proteins with glutathione S-transferase (GST). In general, such fusion proteins are soluble and can easily be purified from lysed cells by adsorption and binding to a matrix glutathione-agarose beads followed by elution in the presence of free gluta-thione. The pGEX vectors are designed to include thrombin or factor Xa protease cleavage sites so that the cloned target gene product can be released from the GST moiety.

In an insect system, *Autographa californica* nuclear polyhedrosis virus (AcNPV) is used as a vector to express foreign genes. The virus grows in *Spodoptera frugiperda* cells. The polypeptide coding sequence may be cloned individually into non-essential regions (e.g., the polyhedrin gene) of the virus and placed under control of an AcNPV promoter (e.g., the polyhedrin promoter).

Once a molecule of the invention (i.e., polypeptides) has been recombinantly expressed, it may be purified by any method known in the art for purification of polypeptides, for example, by chromatography (e.g., ion exchange, affinity, and sizing column chromatography), centrifugation, differential solubility, or by any other standard technique for the purification of polypeptides or antibodies.

Certain modifications and improvements will occur to those skilled in the art upon a reading of the foregoing description. It should be understood that all such modifications and improvements have been deleted herein for the sake of conciseness and readability but are properly within the scope of the following claims.

7. EXAMPLES

It is understood that the following examples and embodiments described herein are for illustrative purposes only and that various modifications or changes in light thereof will be suggestive to persons skilled in the art and are to be included within the spirit and purview of this application and the scope of the appended claims. All publications, patents, and patent applications cited herein are hereby incorporated by reference in their entirety for all purposes.

Unless otherwise indicated, the bacteriophages of the invention were isolated, processed and analyzed according to the following methods.

7.1 Methods 7.1.1 Purification of Phage.

Stock preparations of bacteriophage isolated from clinical samples were prepared according to protocols described in Carlson, "Working with bacteriophages: common techniques and methodological approaches," In, Kutter and Sulakvelidze (Eds) Bacteriophages: Biology and Applications, 5$^{th}$ ed. CRC Press (2005) ("Carlson," incorporated herein by reference in its entirety).

The bacteriophage stock preparations were concentrated by precipitation with PEG according to the protocol described Carlson and Yamamoto et al., 2004, *PNAS* 101: 6415-6420. Briefly, the stock preparation was incubated in 1 M NaCl for one hour at 4° C. with agitation. Next, PEG 8000 (AppliChem, Cheshire, Mass.) was gradually added to a final concentration of 10% (w/v). The composition was then incubated overnight at 4° C. After the incubation period, the composition was centrifuged at 10000×g for 30 minutes at 4° C. The sediment was then re-suspended in SM buffer (0.05 M Tris-HCL at pH 7.4, 0.1 M NaCl, 10 mM $MgSO_4$) with gelatin at 1% w/v and centrifuged again at 1000 rpm at 4° C. for 10 minutes. The supernatant containing the suspended phage was saved for further purification. The supernatant was purified using a CsCl gradient according to the methods in Carlson.

CsCl was removed from the purified and concentrated phage stock by dialysis. A dialysis membrane, Cellu.Sep H1 High Grade Regenerated Cellulose Tubular Membrane (Cellu.Sep, River Street, USA), was prepared according to the manufacturers' instructions. The dialysis consisted of a first incubation of 30 minutes in 100 mM Tris-HCl and 3 M NaCl (pH 7.4) at 4° C. This was followed by a second incubation of 30 minutes in 100 mM Tris-HCl and 0.3 M NaCl (pH 7.4) at 4° C. After dialysis, the suspended phage was removed from the interior of the dialysis bag and stored at 4° C.

7.1.2 Extraction of Phage Dna

To 5 ml of the purified and concentrated bacteriophage samples was added 20 mM EDTA at pH 8.0, SDS at 0.5% (p/v) and Proteinase K at a final concentration of 40 µg/ml. The mixture was incubated at 56° C. for one hour. Successive extractions in phenol:chloroform:alcohol at a proportions of 25:24:1, were performed until the interface between the aqueous and organic phases was clear. The aqueous phase was then treated with an equal volume of chloroform and centrifuged at 13,0000×g for 10 minutes at 4° C. The aqueous phase was once again removed, and the DNA was precipitated by adding two volumes of absolute ethanol and incubating for thirty minutes at 20° C. The samples were then centrifuged at 11,000×g for 30 minutes at 4° C. The pellet was washed with 70% ethanol at room temperature and resuspended in 50 μl of ultra-pure water (Gibco, California). DNA concentration was determined by measuring the absorbance at 260 nm in a ND-1000 Spectrophotometer. Integrity of the isolated phage DNA was analyzed by electrophoresis on a 1% agarose gel.

7.1.3 Analysis of Bacteriophage Genomes

Sequencing of the bacteriophage genome allowed identification of potential open reading frames (ORFs) within the genome. The putative ORFs of the bacteriophages were used to search the NCBI nucleotide collection database for homologous DNA sequences using the BLASTN program (see, e.g., Zhang et al., 2000, *J. Comput. Biol.* 7:203-214).

7.2 Example 1

Bacteriophage F168/08

Comparison of the putative ORFs of the bacteriophage F168/08 genome with the sequences in the NCBI nucleotide database revealed that only small portions of the genome (≤1%) exhibited homology with known sequences. The F168/08 ORFs, their encoded amino acid sequences and known homologous proteins are provided in FIG. 2. Prediction of orfs was performed by integrating the results obtained with GeneMark.hmm and MetaGeneAnnotator programs (Besemer, J. and Borodovsky, M. 1999. Nucleic Acids Res., 27: 3911-3920; Noguchi, H. et al., 2008. DNA Res., 15: 387-396). Protein homology searches were carried out with BLASTP program (Alschul, S.F. et al., 1997. Nucleic Acids Res., 25: 3389-33402) using the NCBI non-redundant protein sequences database. Protein conserved domains were predicted using NCBI specialized BLAST (Marchler-Bauer, A. et al., 2007. Nucleic Acids Res. 35: 237-240). orfs whose products presented homology with the same protein(s) are indicated with the same number added of a lowercase letter, in FIG. 2. Identification of putative transfer RNA genes (tRNA) was carried out using the tRNAscan-SE progam (Lowe, T. M. et al., 1997. Nucleic Acids Res., 25: 955-964).

FIGS. 3A-B provide the results of spot tests that assessed the activity of the bacteriophage F168/08 against 105 *Enterococcus faecalis* (A) and 56 *Enterococcus faecium* (B) strains isolated from clinical samples. Each spot consisted of 5 μl of bacteriophage suspension with the indicated titers, prepared from a CsCl purified lysate. Sensitivity to the phage is represented as a scale ranging from turbid (+) to clear (++++) lysis halos. Resistance to phage infection is indicated as (−).

7.3 Example 2

Bacteriophage F170/08

Comparison of the putative ORFs of the bacteriophage F170/08 genome with the sequences in the NCBI nucleotide database revealed that about 94% of its genome was highly similar to that of *Enterococcus* phage ΦEF24C, with individual ORF identities ranging from 80 to 100%. The F170/08 ORFs, their encoded amino acid sequences and known homologous proteins are provided in FIG. 5. Prediction of orfs was performed by integrating the results obtained with GeneMark.hmm and MetaGeneAnnotator programs (Besemer, J. and Borodovsky, M. 1999. Nucleic Acids Res., 27: 3911-3920; Noguchi, H. et al., 2008. DNA Res., 15: 387-396). Protein homology searches were carried out with BLASTP program (Alschul, S. F. et al., 1997. Nucleic Acids Res., 25: 3389-33402) using the NCBI non-redundant protein sequences database. Protein conserved domains were predicted using NCBI specialized BLAST (Marchler-Bauer, A. et al., 2007. Nucleic Acids Res. 35: 237-240). ° ifs whose products presented homology with the same protein(s) are indicated with the same number added of a lowercase letter, in FIG. 5. Identification of putative transfer RNA genes (tRNA) was carried out using the tRNAscan-SE progam (Lowe, T. M. et al., 1997. Nucleic Acids Res., 25: 955-964).

FIGS. 6A-B provide the results of spot tests that assessed the activity of the bacteriophage F170/08 against 105 *Enterococcus faecalis* (A) and 56 *Enterococcus faecium* (B) strains isolated from clinical samples. Each spot consisted of 5 μl of bacteriophage suspension with the indicated titers, prepared from a CsCl purified lysate. Sensitivity to the phage is represented as a scale ranging from turbid (+) to clear (++++) lysis halos. Resistance to phage infection is indicated as (−).

7.4 Example 3

Bacteriophage F770/05

Comparison of the putative ORFs of the bacteriophage F770/05 genome with the sequences in the NCBI nucleotide database revealed that only small portions of the genome (≤1%) exhibited homology with known sequences. The F170/05 ORFs, their encoded amino acid sequences and known homologous proteins are provided in FIG. 8. Prediction of ° ifs was performed by integrating the results obtained with GeneMark.hmm and MetaGeneAnnotator programs (Besemer, J. and Borodovsky, M. 1999. Nucleic Acids Res., 27: 3911-3920; Noguchi, H. et al., 2008. DNA Res., 15: 387-396). Protein homology searches were carried out with BLASTP program (Alschul, S. F. et al., 1997. Nucleic Acids Res., 25: 3389-33402) using the NCBI non-redundant protein sequences database. Protein conserved domains were predicted using NCBI specialized BLAST (Marchler-Bauer, A. et al., 2007. Nucleic Acids Res. 35: 237-240).

FIG. 9 provides the results of spot tests that assessed the activity of the bacteriophage F170/05 against 100 *Pseudomonas aeruginosa* strains isolated from clinical samples. Each spot consisted of 5 μl of bacteriophage suspension with the indicated titers, prepared from a CsCl purified lysate. Sensitivity to the phage is represented as a scale ranging from turbid (+) to clear (++++) lysis halos. Resistance to phage infection is indicated as (−).

7.5 Example 4

Bacteriophage F197/08

Comparison of the putative ORFs of the bacteriophage F197/08 genome with the sequences in the NCBI nucleotide database revealed that the genome was highly homologous with multiple staphylococcal phage genomes. In particular, about 90% of the F197/08 genome is highly similar to that of *Staphylococcus* bacteriophage phiSauS-IPLA35, with individual ORF identities ranging from 80 to 98%. The F197/08 ORFs, their encoded amino acid sequences and known homologous proteins are provided in FIG. 11. Prediction of orfs was performed by integrating the results obtained with GeneMark.hmm and MetaGeneAnnotator programs (Besemer, J. and Borodovsky, M. 1999. Nucleic Acids Res., 27: 3911-3920; Noguchi, H. et al., 2008. DNA Res., 15: 387-396). Protein homology searches were carried out with BLASTP program (Alschul, S.F. et al., 1997. Nucleic Acids Res., 25: 3389-33402) using the NCBI non-redundant protein sequences database. Protein conserved domains were predicted using NCBI specialized BLAST (Marchler-Bauer, A. et al., 2007. Nucleic Acids Res. 35: 237-240). offs whose products presented homology with the same protein(s) are indicated with the same number added of a lowercase letter, in FIG. 11.

FIG. 12 provides the results of spot tests that assessed the activity of the bacteriophage F197/08 against 100 *Staphylococcus aureus* strains isolated from clinical samples. Each spot consisted of 5 µl of bacteriophage suspension with the indicated titers, prepared from a CsCl purified lysate. Sensitivity to the phage is represented as a scale ranging from turbid (+) to clear (++++) lysis halos. Resistance to phage infection is indicated as (−).

7.6 Example 5

Bacteriophage F86/06

Comparison of the putative ORFs of the bacteriophage F86/06 genome with the sequences in the NCBI nucleotide database revealed that the genome was highly homologous with multiple staphylococcal phage genomes. In particular, about 80% of the F86/06 genome is highly similar to that of *Staphylococcus* bacteriophage tp310-1, with individual ORF identities ranging from 85 to 100%. The F86/06 ORFs, their encoded amino acid sequences and known homologous proteins are provided in FIG. 14. Prediction of orfs was performed by integrating the results obtained with GeneMark.hmm and MetaGeneAnnotator programs (Besemer, J. and Borodovsky, M. 1999. Nucleic Acids Res., 27: 3911-3920; Noguchi, H. et al., 2008. DNA Res., 15: 387-396). Protein homology searches were carried out with BLASTP program (Alschul, S. F. et al., 1997. Nucleic Acids Res., 25: 3389-33402) using the NCBI non-redundant protein sequences database. Protein conserved domains were predicted using NCBI specialized BLAST (Marchler-Bauer, A. et al., 2007. Nucleic Acids Res. 35: 237-240).

FIG. 15 provides the results of spot tests that assessed the activity of the bacteriophage F86/06 against 100 *Staphylococcus aureus* strains isolated from clinical samples. Each spot consisted of 5 µl of bacteriophage suspension with the indicated titers, prepared from a CsCl purified lysate. Sensitivity to the phage is represented as a scale ranging from turbid (+) to clear (++++) lysis halos. Resistance to phage infection is indicated as (−).

7.7 Example 6

Bacteriophage F87s/06

Comparison of the putative ORFs of the bacteriophage F87s/06 genome with the sequences in the NCBI nucleotide database revealed that the genome was highly homologous with multiple staphylococcal phage genomes. In particular, about 82% of the F87s/06 genome is highly similar to that of *Staphylococcus* bacteriophage ΦNM3, with individual ORF identities ranging from 90 to 100%. The F86/06 ORFs, their encoded amino acid sequences and known homologous proteins are provided in FIG. 17. Prediction of ° ifs was performed by integrating the results obtained with GeneMark.hmm and MetaGeneAnnotator programs (Besemer, J. and Borodovsky, M. 1999. Nucleic Acids Res., 27: 3911-3920; Noguchi, H. et al., 2008. DNA Res., 15: 387-396). Protein homology searches were carried out with BLASTP program (Alschul, S. F. et al., 1997. Nucleic Acids Res., 25: 3389-33402) using the NCBI non-redundant protein sequences database. Protein conserved domains were predicted using NCBI specialized BLAST (Marchler-Bauer, A. et al., 2007. Nucleic Acids Res. 35: 237-240). coifs whose products presented homology with the same protein(s) are indicated with the same number added of a lowercase letter, in FIG. 17.

FIG. 18 provides the results of spot tests that assessed the activity of the bacteriophage F87s/06 against 100 *Staphylococcus aureus* strains isolated from clinical samples. Each spot consisted of 5 µl of bacteriophage suspension with the indicated titers, prepared from a CsCl purified lysate. Sensitivity to the phage is represented as a scale ranging from turbid (+) to clear (++++) lysis halos. Resistance to phage infection is indicated as (−).

7.8 Example 7

Bacteriophage F91a/06

Comparison of the putative ORFs of the bacteriophage F91a/06 genome with the sequences in the NCBI nucleotide database revealed that the genome was highly homologous with multiple staphylococcal phage genomes. In particular, about 82% of the F91a/06 genome is highly similar to that of *Staphylococcus* bacteriophage ΦNM3, with individual ORF identities ranging from 86 to 99%. The F91a/06 ORFs, their encoded amino acid sequences and known homologous proteins are provided in FIG. 20. Prediction of orfs was performed by integrating the results obtained with GeneMark.hmm and MetaGeneAnnotator programs (Besemer, J. and Borodovsky, M. 1999. Nucleic Acids Res., 27: 3911-3920; Noguchi, H. et al., 2008. DNA Res., 15: 387-396). Protein homology searches were carried out with BLASTP program (Alschul, S. F. et al., 1997. Nucleic Acids Res., 25: 3389-33402) using the NCBI non-redundant protein sequences database. Protein conserved domains were predicted using NCBI specialized BLAST (Marchler-Bauer, A. et al., 2007. Nucleic Acids Res. 35: 237-240). orfs whose products presented homology with the same protein(s) are indicated with the same number added of a lowercase letter, in FIG. 20.

FIG. 21 provides the results of spot tests that assessed the activity of the bacteriophage F91a/06 against 100 *Staphylococcus aureus* strains isolated from clinical samples. Each spot consisted of 5 µl of bacteriophage suspension with the indicated titers, prepared from a CsCl purified lysate. Sensitivity to the phage is represented as a scale ranging from turbid (+) to clear (++++) lysis halos. Resistance to phage infection is indicated as (−).

7.9 Example 8

Bacteriophage F1245/05

F1245/05 ORFs, their encoded amino acid sequences and known homologous proteins are provided in FIGS. 23A-I. Prediction of orfs was performed by integrating the results obtained with GeneMark.hmm and MetaGeneAnnotator programs (Besemer, J. and Borodovsky, M. 1999. Nucleic Acids Res., 27: 3911-3920; Noguchi, H. et al., 2008. DNA Res., 15: 387-396). Protein homology searches were carried out with BLASTP program (Alschul, S. F. et al., 1997. Nucleic Acids Res., 25: 3389-33402) using the NCBI non-redundant protein sequences database. Protein conserved domains were predicted using NCBI specialized BLAST (Marchler-Bauer, A. et al., 2007. Nucleic Acids Res. 35: 237-240). Protein function was predicted based on genome localization of the corresponding gene and on the presence of putative transmembrane domains of the encoded product (TMHMM server v. 2.0; Krogh, A. et al., 2001. J. Mol. Biol., 305: 567-580.

FIGS. 24 A-E provides the results of spot tests that assessed the activity of the bacteriophage F1245/05 against 100 *Acinetobacter baumanni* strains isolated from clinical samples. Each spot consisted of 5 μl of bacteriophage suspension with the indicated titers, prepared from a CsCl purified lysate. Sensitivity to the phage is represented as a scale ranging from turbid (+) to clear (++++) lysis halos. Resistance to phage infection is indicated as (−).

SEQUENCE LISTING (816 sequences)

SEQ ID NO: 1 - DNA, 58199 bp, Unknown
  Description of Unknown: Undetermined Bacteriophage F168/08 polynucleotide
tggacaagctttttccataacattgtgggctatgatgagccattatcaaaagaagttttaacagcttatcacttaaaagaaattactgatttaaatgagcttcctgagcatcataagaaagtatttgaaacactttcagcaattgagtacagcactgtggagcaggctttaaaaacatttaaaactaattatgtggagggaatttagtatggagttcttaaagtatccatcattagtcaatcattacgctattggaaagtcaaagcgtttagtaaatcgttttgataatattctttggtatgcctctgagaaaatccatggagccaacgcttcttatgccttatcagcaactggggaagagtatttcgcaaagcgtagtggaattatttctaaagacgataaacaattttcaatgcttccagaatgtgttacctcagacattcgagaaggtaccaaaaaagcttttcgaatactatcctaaagcagaatcaatccacgtatttggagagttctttggcaaaggcgttcaagtaatggattacgaccttgttaaagaaggtaaaaaagcttttcgagtattcgatgttattgctaagtatgatgatggctctatggcagtctgtggaatcaatacttggaaacacctttttgaacaggactccatcgttccttattacacgttaggaaagaccttaaaagagtttttagaaactccaccaagtgaggaatcggctttgggaggttattctgaaggcgttgtattaaaacctctacaaggttatcctattaactctacacaagacttcttaggtgttaagtacaagactgaaaagtatttagaagtcagacacaagccttctgaacagcgtaagaaaccacctaagctgaacaatgagcaagtagaagctttaaatgagcttggtaaatacattactaaacagcgtgtgttaaatgtttgttcacatggtgactttgagcttattcagaataatatcggaaagattatgctagccgttaagcaagacgctgccaatgaatttattaaagaagttggctcaagctttactgaaaaaagagcttgtaggtctctctaatgcctattcaggtgaaatcgcaaagtatattaaagaagtaatttatgaaagttcacttgagctgttgacagataattaattaagtgatatactgctaatataacaactttgggaggaatttttttatggattttaacacacttattgaacaagtacaagaatggtcagctaacaaaggattagacaaagctgctcctgagaaacaatttttaaaagttattgaagaggttggagaagtagccgctgctatggctcgtaacgaccgagaagagcttgtggatggccttggagatacttttgtaacattaattatcctttgccaacagcttggagtagttcctcatgaagctttagacactgcttatggagttatttctaagcgaacaggcaagatggttgatggagtttttgtgaaaagcgaggatttataaggtaatttaataaacttaaccaacagcctttaggaagagtaatacctaggggctgtttttttagttttcaaaaaggcaggggagaaattttttaaaaaaatttttttccaaacttcaaaaaatttaaaaaatttttcttaaaagtttttcctaaaagcgctactggattacattattagcgcttattttacatatttattgaaatagcgtgtcgcacaggcgcattctgagcgcatttcgcactgctttctgcacaactatccacatatttgttgtgtggcgccttatatatgctgttgcacatgccttgccactgcttttgcttagcattattggattaggctactatatatgcactatcatgtgcctttactatatcctatcccctatgctttatagatagttttactataggttaccttaggttatgttactataccttactatactaccccccccccccagtttccacgagaagtgccctataaggggctttttaagcatttttacgcctttttaaaggcttttcttgctctttttatgcgcctttttgcacgttctttcttaaaatccatcaaaacacttttataacagctttttcaggttgtttttaaaagtttctactatataaagcgccgtttttatgtaaaagctgccaaaaagaatttaaaaaagttgtattttattgttgacaggcatttttgaaagtgatatattaaaggtgtagcaacgaactacaaaaataaatttaagaaagaggttttataaaatgatgaaattaatcgaattagacaatgggcggaagcaagttttttacaacaatgttttaatgcaatacgaaagacgtggcagcgatgtatatggcaatccattatatcgagtatatccaataaacttttctttcaaacgtttaaaaagcgtttatagaaattacgaaaaaggtggctgggaagaatcttactatcttatccaaagttataacattttagcggatatgcaaaacattgccagcgaagtaaacgcaaaaaacacttttccagagtttgaccaaactttattgaaagattatcgggaggtttcggcgtatgtataagaaaaccattgaaaaattatacaaaagttatatgagtacttgtaaagagtttcgggctaaggtaacatttactcaatacgtgataggagagtactaaaaaatggcgttaacaatgtttgaaaaagagagcttacaaaaagaaaatgcacgacttaaaagagagctggccactttaaaggctagccaaaaactaggcggagggcttaacgaaaaagaattacaaaaggcactcaacagctgccagcgaattttcaaaactttaaatagaggtaaaagaagccttgttctaagtaaatccgccatggtggctagtgtggaatattcgggaagtggtcgctcaaaaaacttataaagattgttccaagacagcaataagagaggcagaaaaaagcgcctgggagattatgagcctagagaacgactttagaaatattcatcactttttgaaacatggaacaatgaaagcggaggacaaagacaatgcttaatattattgtaacagtaatttcaacagcagctgtttttaaaggcgctagaaatggtgaataaaaaactttccgatagacttaccaagtctatcaagttttcaagaaagaaagctaaaaagcgctttattattgcacgtgtgacggaagaacaagcttatactttgcgactattaaaagctatttccaaagaggatgaagctgtatgcaaagccacaaataaagctttgctagaatacggctatgaagaagcaggtgggcattcttatgagaaagctcgggaaaagttttcctctttgcccgatgtaaaaaaatggcataccaatcgacgaactagaaagcgatgaagaagcggacgtacagccttttttaaaaaaatttattaaaatgcttgcaatccgcttggtgatttggtattataaatgcagttagaaaggaggtaacaagaaaatgagtaaagctttttacatggcactaggcggatttttggcaagcttttttcacagggcatgccacagtagcgtattttatggcttgcgctgtagcgttgacaattgcaatccaaacaatttataaaaaaagattagtcaaaatagttgacaagtatttaaaaaagtagtaagataaacgtataagataacaagtaacaaatacacattcgataaggttagggcaatcctttaaaaaaagcctatactaaaataacataaaaggcggtttttaacatgacaaagaatcattataaattatatgtagatatgaaagagggaactcacgattatgtttcggcaactgtctatagtatgtttgatgaaaaagttttatggttgccagatattaaaaaacccgaaaacgtagccgactatactgatgaatggaaaaacgggctatattcttactacgaaaaactcgcaatatcagagttaaacgactacaatgctactttttcacatttataaaaaaattaaaaaactattaacaaaaaacaataactagtgtaaggaggaacaaacctctttacaccacacaacagaaaggaagtttttactatgacagaatttgctaatatgaacaaagaagaggtattggaattacttaatgattggtttggtgttagtgactatgttacagttatggcagaattagaaaagatgaaacaagttacctttacaggtagcacggacatacctttgttaggtggtaacaatgacttgatcggtttacctcaattttttaaaggtaacgaagtagaaccagagttcccaacttatgaagaactattagaggaactagaaaaagatacatggaatcttgaagcagaggacaacacttataattatagtggtttcctagagcgtgatatggactttaaaactattcatgcagaaaattcagacacgactattgcattctttgcaatccatacggggggtagacataagagcgggctactcaaaagcaatcccatttattttttgaaacttactacgattttcaagagttcctaggtaactacttttatggtcaaggttactacgcttttaagcacgataacaaagaatacacaatcagtttagacatttcggctacctcggaatatgtacgaatttatatatctgatgaaaacaatgaggaattacagcaaagttatgaacaagaaacttttatggacttagacagggaaggcgtagaagcatacttgaaagatgaaggaattgagtttactgacttaaaacatgcattgtaaccatataaggcactagggagcttatacaatagagctacaagcttcctagtgtaattataaggtaaacagctataaacgcttagacgagagaatagagggctttacaattaatttaaaaaaagtttcatcttatctattgacaaataacaaaaaactttggtattctatacatgtaagataaataaaacaaatgaaagagagtgttaagaatggaaaataacaaagcgtatgaaagactattgaaagaagtagaactattacagaatgatttaatggatatcgaggactattcagaagaagtatatcaagcttttcaaaaagtaattgacgaattagaatatatacaagcttcctaatgtaattataaggtaaacaccttacacaaaaagtaaacaaaagcatagtaaaacacaaataaaaaaattatatgaaagaggttttcaaccatgacaaaacaatttaaaaacattatcgcaactttaacaatcctagtaatcgctttggcagcagcttcaggaatcgcaacaattaaggcagtagaaaacgcaaatgataaagctatccttgccgaacgtgtggaagctttggaaaaaactttccgataagcaagaatacgatattgcagtaaagtctaatgtaatcggcgcttatctaatcaatcatgaggaagaagcacaaaaggaatataccgaagcttataaagctcacaagccgactctattaaaaaaactaccgtgagtttcacaaataatttaaaaatattttttacaacttaataaacaggaactagaaaagcttttgagaaaacatctcgagggcttttcttttttgcgttttcaaaacgtatgatcagaaaaggcgccatcttaatttatggaatgcttttaaacctagcggtatacacaagcttttctaaagctttctaatggttaaccacccaacttctttcttgaaacgttacgagaagccctctctcacacacataataaagcagtaggcaaaggaatatgcaaagagtattcttaaatgctgttattaatccatcaaaaaggcaaggaaagaaacggaaatgtgagaaagaaatggtaaaagcctattaaacataggatattttttaagaggaatgagagggcgcctaacaatattattccaaagctttttctaaggcgttgtgtgaggggtttttctgaggggtatctaaagggcgtgagcgggcgtaatctcaaggcgaatcttgaaaggcaagtggaaagctttgtggtggatttgttttttattaaaggaaatgagaagcctttgcggaatgctgtagcggcgggcttgtgggagaggtggctcgagaggttgtcggatagctttcagatagactgacactaaacaaggcacacacgaagccatcacgcggcattatagaggcacccgaaaggtgtccgaacgctgtccgcaaggcttacacaacggctagtttacataatacacattatccaaagtagaaagaccctatctcaatgcaatgttaacagcaaagagacagagtctacatcgagtcgcttgtgtgagcgtgtcggacggcgtgacgtgagagcgtcgcagagcactcgcaacgcctctcgaagcgtgaaggaaggcgtagggcgcaggcgtagccacggcgggcgggggtctttgggaagggcagggggtagcttttccgagggcgggcggggcgcgcgactgtccatctcacacagtttttgggaaaagcgacattataagccttccgatttattttttgctaaaaatcccctataaggcgtcccgacacacttcccgacaagctttccgaggccattccgacaagctatccgataagcattccatcaatagacgtccgaaagctttaaagctacctttcctgaaggctcttccttacttccttttaagaatagattccacaaatagagagggcgccgcttgtcggcagccctagaggctttgcctctttctagtggagtattcacacaagcgtttattaagttgtaggatggattaggtaccatttactaagcggtagccaaaccgttagctaaacgaatttttctcaacatccctttaatgcgttctagcatagcttttaacacacctttcttatcgtttcttatagtataccataaaaaaagaggccatgtcaagctccttcaaataattttaaacatatttccaaataaatcctttgtgtgttttgctttctcctcttgcacaagaggctacatgtgatttatcgaatccataacttattacttcactgactgtttggaaagttatctcctcaccagttttaatatttactccttttacaggctttcctttgcttaaacttattttttgtattcctgctaccataatttgaattttctttatttgttacccactctaagttatccactctattatcatgtttaacttcatttaaatgattaatttgaggctttttaaagatgttatttataaaggcgttagctactatcctgtgtactcggtaagttttctggtttcctttcttagtcaacccaaccaataagtatccttttctatcttttcttaatttcattaaagaatttctggagcagttaaatatatctccttggtcagacaccatataaagcccttcataaccttctatatctctccattcaaccatatcctttacctccgcttttaatatactttattatataatagaaaagacgcctgtcaaggcgcctctaacattatttctctaagtcttccttagcttcttcatactctttatgaagcatatcccagattactttaaggataattaagtttcctaaaatccgtccaatagctattgtgacgcttgctccaaacaccaatgtaatgactacaataagcccgaatgcaatcaccaatgctaataaataatataaggatactagtcgaaaagctttccaattcatattaaagttcctccaatgtcttatgtttatctttgttatagcggataaatgcgtacttagtagtttcccaaagtaggtctatcaagaatagcactccaagatagaagaaaagctgttcccaaccagttattaaggatactagccaaagtataccgaagattattccaacagttatcagataagctatgataacggctgccaatataatgcgtttagtaagtttctcagacaatataattcccaactcctttaacaagctctctgcaaagcgtaattttaactgttttatggaagcgtgttgaatggaactctacaggcgtttctgaataagtttcaataatcacgtctttaggcttttttgcgagtaaccatttcaataagactttcagaaagtgttaaaatacctgctttataaggcatataaaagacgtttgcctttcttaataactgctgtggcgagtcgcttacaaagtgcttttcagaagacccttctgatttaatccagtacgtgtattcaggctcttcttgaaggcgtggggaatacccttccttaatctcttgcaaggcattatcaagcatttcctgaatctctttagtatcaactttaatagtagctgttagttgaggcttacttggaattgctttttgaagctctctatactctcttttaaggccattgtactcctcttgtaggcgtcccatttcctgttcccagcgcttgttttgctcctcttctactgtaagcttttgacagacttcttcaaacttcttaccaagtctatcataagcctcttgtctaagcaggctttcttcagcggactcgttggccatttcaatagcttctacttccttctcagaagcaactttaaggcgctcttcaaagccagcttctctaatctttaagaagtctacctctttttgaagctcttcgttagccatctctaacctatctaaggccagttggtagacagcttttctgccagtcaataattcaatctcttgtttaagctctttaataagcttgttttcgtccttcttaaataacatcttatcaatcctttcctaatactccactagtatagcataaaagaggcctgttgtcaagcctctcctaacacttttttaaccatctaacccaaaatcttccatacggcagaatccataaccgttctcatgagcgtaaatgccctcatgatagaggtcacaaagctcttggataacccctttaggtaccccatacttagtggaagctttctccattcgtgtaacctcttctaaaacctctccagtagcatcgtcaaagactaggatgcgcttattgttgtcgtagtagtgtttaaggttatcctcatgtgttaaccattccaagttatctaggttgttattaagcttattgccatccatatggtttacagtaagctcttcccaaccttctattggattgtaagtggaaagcaatacccgatggagtcttttaatattcccatcgcctagtccaatttccgcatatcccctatcatttataaaaggctttagaatcttaccagttaggttattaacgaccttaccagtctttgttatggagtagttagaaaacccattaacaaccttccactcaccctccaaatacttttttgatgggctttttagaagctagtggagaacctttctcaaactctcttccagtataactccacacatgccctgcatacaccttattttttagcacaggcattgcggacacttgttgaatacttccctaaatccttagaagcagcataggcgcttctgtaaactgtttctaaacctgtctcaacgtctactgatttaacctcttttataagcttcactaaaaaccctcctaagtcctcttctataagcatattgtagcacctttcaggcgccttgtcaatatcctttatgttacatttgtgttacaaacattaaatttactttacagttataaaatattccatcaaatagtgagactaatttaaagcatgtgggaaatactgtcatattagttaagagttagttagcgaagctactaacgagcgttactccagcgagttagtaaatcacttgacctttcctaaaagcttcctgaaacgttctcctaagccttcctaaagctttgagacgtctaggttacaggtcggggatggagtcagttgttaattactttaaggacgagtttgtagaaagcttattaaatcgtatggcctcacctaatgcaaagtgccagcagcgacctttagtaggcttcctagagactcgttttaatatgtaataagaaaagccttcagggtagcttcccgaaggccttctttatgctctatttataggcttccataattccatcaatgaagttacattcgtcccagtcttcagaacgttcttggatagcttctaaaaggcggataaactcacttttttggaatcatgtctgaaggattagccaaaggaatttcatcctctatgataatgtctttcacaaggcctttgatagattcaatgcctctaatgaaacccgcatcccaaccttttccgaattttgaattattcgcaggactggttgtatttaattcatttttggtcttttcaatgtaatttaatactactgtggcatcgataagcttcataaaatcactcctttaccttttggaatagcttggatagcgcctttcaacaaggcttgaatctcagaggcatcatagaagtcctcagaagcctctaggagagcttctaaaacgtctttggtataattgttaggcaaggtgttaataggcgttacagagcttcctgtaaaggattctgctacaatgtttccatcgacagctaatttaataggctctggtgaatcctcttccttagctaccgataaagctgctttaatttcgtccatacaagtttctacagcgtcctgataaccctcatcgtaatcatcttctgggtattccaatttgttttttcatagtggttaataaagcttctccatcgattagtttcattaagcttcctccttaacagtttcaataaagaccttcaaacgaggtgggtggaatccactaatagctgtgtcgaagtcttcgtccaacatcactactggaaagcttcggaaacccactaatctaagcatctccacagtctctgtatcattgcggacgtccacaaacacttcatcaaagcttacacctgcttcggtaagcactcgtttagtcattttgcaagctgcacatgcgtctttagtatatactttaatacggttcattcccattcctccatgctttcaataatctcttcaagctcttctacacgttctgaaagcgtgtcaacttcttcggtaagctcttccacagtttcttcagagcttccaagctcgttctccaagtcgtatacctgtccttctaagtcttcaatttctctttcaaggctataaatctcctcgttcaagtcttcttttttcccatacaacactagtaaggcgctcttctgcatactctaattcctgttcagcaatcagcttatcccaattggaatccaccaaggcattttgaagctttcctacaagctcaattaaagctgtttcacgttgcgttaatgtaggctttgaacaagcctctttcaattctttctcaaaaggtagtttgctcatattaaaactctccaatctcttcttgtttaaactcttcaacagtaatttcttgcattaaacattatcctcccacttcttatcttccttagccaagtattgcttagcttcagtaaatagttctgaaagtacctctaaagaattagtaaggttatcgatggcttcagtaacttcttctacagcagcctcgaactcagattcggtaacgtcagaaacctttgcactaagcattcctgtcagattgtagacagtcgtttcgacatttgcttggtctccttctaaatacccaatctctaaaaagttatagtagttatctaattcaatgccttccattattccttacctccagactccaactcttcagtaatcttctgctgctttctaatggttcctaaatattccataagctgcttttcgtcttcttctgcttcgtcagaaacgatattctcaataagctcgtgatattcttgaaccttttgggaaagcttctcaatatcttctgcatactggttagcgattaattcatgagccttctttgaaaagctattattaagctcgaagtctgcggcagcttttcgtactgtaccaagcttctctaaatactgctgataactcttgatggagtacatcttaattgctctcatctttattcctccttaaatgcctgtgtaaggcgttctaatgtgttcaggtataattaccctagaagctattcaaaagctctcagagagcttcctgtggcttttaaggtatgctttagcgcctgtttgtcttttacataaataactataacatggttgtcttgaaatgtcaagcacttttttcacaataaattaaaaaaatgtgacaaaaaagagccagataaggtctaatctaagaggctcttaaacgagcttgaataaatactccagaaaggaggaagcacttatggtaagaattggaaacagagagttggaagaacgtcaacgcaagtatttaactacttctaaggagccagatgaatacgagggagttgacttaactacattaaaacctaaaatgaaacgctttgcgagacattatatgcaaactatgaatatcgctgaaagctgccgttccgtaggctataatgaaagctcaggttatcgtgtgttaaaacgcgaggatgtgaaggcttatttacaatggcttgtttcagagaatgctgacgcagctattatgagtccaacacaggtattagaagagcttactaatatcgctttacgaaacagctctgattacacggttactgtaaaaggagatgtcgtagagaaacctattgatacaagcgttcaattaagcgcactaaatagcttggctaaattccatgacttattagcccctgatgtcaaggtagaacagtctcttaatatcgtggtagacattgctgacgacgttccaaatgaagctgaagaggttgaggaagaagagtttgtagaaggagactttaccgaagttgaagaagaggatagtgacgtaagttatgacttcctttctggatttttaaggaaggagataccaatgccatttgaagagagtaacttagaggttatcgtcaacgaccttattaaagacgttaacactcatgccaaccagattgcttctattcagtcagacctaaatagaatgacaacagacatttcaagcgttcgtgacttgcttatcaaaaaacactgagcgttcggacgttctaatcggccacatcaaaggccagtctgacgaaatgcttaaactactcactgaggagcgtcgtagacaaacggaaagctaccttgctgatgaagcttcagaccgcaagaataaagagtttagtcaaaagcagatgtgggctgtggccactgctcttgtcacaggagtagggtcagctttagtgaccattgttaagctaatcatgagctaattgaaaggaggtgcattaatggacgtagtaatttctatcgcagttgttttaggtggcgttaccacaggcttagttaacttagttaagtctatggatgtagtctctcctaaatacttaccgctagtttctctagctatcggaatggtgtttgggttagctatgtcaccacttcttggaatcacattatatgtaggtgctattagcggacttgtagcagggctttccgcaatgggattctacgagttgacaaagactccagcagaataaccttcacacggccttgagggagtttccttgaggcctttacataattttaaggaggacacacaatggctgaaccaataaaattaaccataaccaaaagaacatttaatgaagcctatttaccatacatgtacaaccagcctgaaggacaacatagaacaatggtatttttacggaggagctgggtcaggcaagtctaagttcgttgtacaaaacgctattctaaaaggcctatcagaaagacgtaagttcctcgttcttcggaaggttgacaacactattcgtgactccatcttccaagagtttctagtctgcttagaggaatggaatctgctagacttttgtgaggtaaaagcttcatacatgacaataaagctgcctaacaaaactgaatacatcttcaaaggtttagaagaccctgagcgaatcaagtctatccaaggtcttacagacatcattatggaggaagcaacagagtttacacgagaggattacgaccaacttcaaacacgtttacggcaccctacagcacggcatcaacaagtatttgtaatgtataaccccgcctctaaagacaactgggtttatcaatacttccacaaccctgccactaagcgtcctaaaggctctaaggtaatctgtacgacatacaaggataatagattccttcctaaagcttacctagaccatttacaagacttgaagaacactaatccagtctattatgaaatctacgctctcggtaagttcgcaagcttaggtaaacgcatttacacaaactggaagatagactccgagttcaagcctaaccaactagttaaacaaggatatgaaccacgcttcgggttggattttggtttaagtatgtagaccacttagctagtaatagcttcgattaaacttcgtgaacgcttaataaagcggtgttaagtaactacttagctaacagggaaagtctaagggcaaaaagcctatgataatcctgtgcctagcccttaggggaaggtgcaacgactaaattctcaagtagcacttgtcgagaggacatgtgtaagaactgagtaagaggaagtcttgagataggcttccgtagtgcgaaggctcttaagtaacgctgagagtatgatatagtctagtcccttttaaatatcgggaaaccgagggtatagccgtcactaacgaccctaccgtaatcctttctacactagtatctgaagcagaccgtgtaatttatatattcgacgagtttgttaaaactggtatgatagctcctgagatattcgatgtgattaagcgtaagaagcttaccaaccagcttatctatgctgactctgctaaccttgaaaccatcgagcagattaaacgcttaggggcacgcaagattaagcctgttaagaaaggccgtaacacagtccttcatggaatccaatatctacaaggctatacaatctacgttcatcctcgctgtgttcacacgattaaagagcttgagaactacgagtggaaacctgctaaaggctctgacgactacgagaacaagcctaagcaaaatggctttgaccactgtatggatgccttacgatatgctgtcaacgacctcattccacgtaacagaataagaaccattaacaagtcggtactaggcctataagacgtctagtatctgtcttgggtacaagtatcagcgaaaaatataaggaggattctatatggcaatcccaaacggacaaattaacgctggtgatataatcactactaacatcagacgtaaacatttcattagacgcaactatgatattcgagaattagtaacccttgccgaaatgcactctcgttcttcaagcgcctatggagtattgtacgactattacaaaggcaatcacattgctatccaatcacgtactttcgacgacactaacaaacctaactctaaaatcgttcataacttccctaaactattggtagacacttccacagcttacttagctggtgaaccaattacggaatcaggcgatgagaaaactatcaaagccatgcaaccagttatgaaagagaactatgtaacagatgttaactcagaggagattaagctctcaggaatcttcggtcactgtttcgaaatccattggattgaccgtaacaacaagcatcgcttcaaagctgtttctccaatgaactgtttaattgcttactcagcagaccttgacgaagagccattagcagccatctattacaatactgttatcagtgatattacaggacacgtaattagaacttatgagatttacactgaggataagattcttaaattctctaccgacgacgagagagacgtctacaaagagattccagaagtgttggacattagaggttatgaagaacatcctaacctacttaaaaagttccctgtattagaaatcattgctaacgaagaacgcttaggtgactttgaagctcaactatctttaatcgatgcttacaacctagctgtttctgacagtgttaacgacattgcttattggaatgacgcttacttatggctacaaggatttgaccttagcgcagacagcgattcaattagcaacatgaagaatgatagagtaattgtaacagatgatactggtaatgtcaagttcattacgaaagatgttaacgacaagcatatcgaaaacattaagaaccgtgctaagctagacatcttcagcctatcacaaacgcctgacttggtttctaaagacttcaccgcagcttcaggacaagctttgaaagcagctacgcaaccgcttgagaataaatcagctgttaaagaatctaagttccgcaaagtattagctaagcgttatgaacttatctgtagttaccttgagctaatgagcaaagagaaagacttgaaaccaaatgaagtaacacctgtctttgtacgtaacttaccacaatcttacgcagagttagctgacatggctgttaaacttcgtgacatgcttcctgacgaaactatcattaatcagttcccatggattactgacgctcgactagaagtagagaaagcggatgaacaacgtcagaaacgagcagacatcgccttgcagaacttcaaacagactagcgctgtacaaggagcctcaacggcagctgctaacaagttagataagaaccctgctaacacatctactatcacaactactgacccagtggctgcgaaggaacaagagaaagctatccaaaagaaacctaagactgactaggaggaataacaatggcacgcaagaaggataaagagaaacgtcaacaggaaattgaagacgccttagttgctctcatgaccgctcagaaccacaagtaccatagattcactgaccgcttcactgtccttcttgatggctttgttaatgagcttatagtaaacctagctgaccctaagttggatgcttttgcaatccttcaggtgagtcagtatgaggctatcagaaagcttcaagcagcattgatagactatcaagaagagttcagggagatgcttttagagagcatgtcagacaccttagaagagactttgggacagctttttccaaataaggctataccttcagcgacagataatgcctacatcgaacaagttattgcagaggcttacgactactttgaagaaatcttcttgcaattattagtagagattgaggccatcgctgttggaactattccatcaacagaggacatcgtaaccactatccaaaagcttcgagatagattgtcctacacactacgtcgacacattgaagctcaaatgtcggcagtaattaacctcgctgttatcgaagcttctaaacagtatgagattgaattatggaaatggtgcatccgtccagagcttactgaaagcggtacttgtgcagattgccgagagcttgctgaaggaggtattggtaatgagggtctatataccctagccaccatgcctttgctacctagacatccacactgtgtttgcatcctaattccatacgtcttatagagcggtaatgttaaagggcgctcaagaggaaaagaactttacacaaactaatctaaacgcacgcacagggcttaattgaactgtggagggcagaaggagaatcttatattatgaatccagaagaacaaggacaaggacaacaagttgatttgacaccagaggttatcgttggagctattgaatctaatccagaattagcacaagctatccaacctcacgtcttaacgaaagacgcagtatctagtttcttaaagacagacgaaggtcttggcgtagtagcccctatgattgaccaaagcgtttctaaaggcattaacgcttggaaagaaaagaacttagagaatatcgttcaagagcgattggctgagttaaaccctgctgaaacacctgagcaaaagcaattgaaacaaatgcaagctcaaatggcagctattcaaaaaagataagcaaatgttggaaatgcgtggagtagctcaagaagctttagcaaaagctgggttgcctgcctcattagctgggtacgttttatcagacaatcccgaagccgttaagcacaaggtttcagaattagatattgaaatccagaatatcgtttcaggactagttgaccagaaggttgctggaatcgcagctaaagcagctccaacaaactcagacgacatgtcaagcattggcggttctaaaactgtagaacggttaacagatttaactgttgaagaagcgacagaactagctcgaactaaccctgctaaatatcgccagttggttcaacgtggttaacaacagataatcatataaactataaacatatagaggagactattaaatatggcacatgaagtaactaaaattgcagacttaattaaccccgaggtaattggtgcgttccttcaccagaaaatgttagacaacttagtattggctccatttgcagaaattgaccgtactttacaaggccgccccggcgacactttaacattaccacaatggaacttcatcggtttagctgaagacttagcggaaggcgaagaattacaatctgttaagttaactgctgaagaccgtaaagcaactgttaaaaaaggttgctaaatcagttacgttaactgacgaagctgtattaaacgcttatgtacgtccagtcgatgaaactgttcgtcaattagctatggcaatcgctggtaaaattgataacgacttgttcgctgctatgcgtgcattaactccatcagacgttgagattacagatagctacgaatgggtattagacgctcaagttgctttcggtgaagagtttgacgaagaaacttacttattcatctctcctaaacgtcgtgcgacaatcttgaaatctaaagacttcgtacacattcaacaaggcgtttcagttatcaaaggccacttaggtgaaatctacggaatgaacattgtagtttctaacaagattggtgaaaacgaagcgttcgtattgaaacgtggagctttaacattgttaatgaaacgtgactacatggttgaagaagtacgtgaaggtatgaaacgtcaaactaacatcactgctgaccaacactacgtagcattcgttaaagatgctaaacgtgcaatcttcatcaacaaggtagctgcgggaaagtagcagcccccaagaatcttcaatctagcggggttactgaggactcagttactctgacttgggaagacggaggggcaagcctctagtaagctaaacgagaggttgcggaaatgttccgtagcctcttttactttatcacacaacaggaggaaaagcaatggcaaagacttataatatttaccaagatgaagtgaaggttcaggaaggcgtagcagagcttacgaaaaccattacaggacttactccaaacacttcatacaagtttgaggtgacagctgtcgaggaaggcgttgagagtgctaagtcaactgccgttacagctaagactaatccacgtaaagtggctacagtaacggcttctcaaaagactatgtctctagcttctgacggaagcaaagcactgactttcacagtggctccagaagacgctactaacaaagaattagaaatcactaacagcaaccctgagtttgctacttatgcagacggtacagtaacagctgttgtagcaggtactacaactatcacagcaactgctaaagatggttcaggcgctactgcaaactgtgttgtaactgttcaggcaccagcttaataaactatcccaaggaggctgaggcgaatcgccttggtcttcttttaaggaggaagctaaatggaactaattgagaacacggagttgttcaagtcgtttgaagacgttaccctaccgcctgaaacagaagctattgacatcaccgacttaaagcttatgctaggctacggtaacagcactatccgagacaatgttctgaaggttttgaagaagcgtgctagacagcatatctgcttattcattaacaaggaagttacagactttccgatggagttggactacattgctgacgagcttactgcaagccgtatgtcacagcttaactcagaaggcttgaaaacagagtctactgacatcactcgttacgactataaagacgacatctatgcaaactggtatggcattcttaaccgctggttagaacagcaaggagagtatcgcaacaaggcattcttcatgctttaagaaaggagcttacaaatgcgttataacgacattgtggatttaatccaattcaatgattgggaagaccctgacgacgactacggaacaatctcttataagactcgtggaacaatcgttgttaaagaccttcctgtaagcgtaggctccctacgagttcaaggaaagctattgcaaaaccaagaccaacagtgggagaaacgctacttgatacagcataaagtattcgagttaaagaaccttcgggtagacgctgtccgacgccactccacaggagagattctaaatgtctattgggataacactactggaacagaccagacagtttcttataaggttgagtacagagacatccgaagagacaaggaggacggagttatatggcagggttcttagaaataactaaacgaatcgatttcgcaggcttagagagagagtttgttaatgaagtgaaaggtgttgtcgaaaagaactccgcacagatggccacagctgttagattaaatatcgtccgtagaggtaacatagacacaggaacttactacgatggaataaagtctaagacggaagtagaagggaagggtaaaagcgttacaggaattgtagagtcagacgtttcaggaaacccttatggacacagaggttacgctgtttacctagaggaaggaacttaccgacatcaagcattccctaactttacagacgctttagaagagtattctgatattcttgtcgagcagcttagcagaatcaaagtgtaggaggaattatcaatgagcaatagaccacctttccgagcaagaagttcctctgtagctttgcaaagagctatcgtaaaggaaattagagcacaaggaatcaatgtctgggacggaactaataagtttccagaatatccattcattaagattggtgaggagctaacttcaggtagaacaatctctaaggatgctatcgggaagatgcacaacctaacccttcacatatggagtgactacgacagctcttttgaagttaagagtctaaccgactttcttgtagacttacttatcaactctcctcttaacttagaggacggcttctgtattggagagaaatccctcgaccacgttcgttacacagaagctgcaaacggaacttataaaaacgagcgtgcatatctattcttagacttcgaggtaatcgactctacgatagagccataataacacacataaaggagactgacaaatggaagcatgtaaatctagctacattcgtggtacagcagtattaattgaggttcagaatgaccttggcgaatggattaaagtagcagcacaacgaggcggtacattaaaccgtacagcggcaaccttagacgtatctaacaaagaaggattcggatgggacgatgcagaagcaggtaacaagtcttggtcaattgactgtgacggattgttcgtagaggataacgctggtttccaagcattgaacgcagcttgggttaatggagactgtgtacgtgttcgtgttaaatttcctagtggattaacttatgtaggacaagcaatcttaactgacttcccttatgagtttggttacgaagatgctgtgacttactcattaacattccaaggtaaaggcgctttagaagagcaacaagtagctcctacaatcttacctaagaaagttgagttcacaaacgaaactaaggaagttaaagttggagaaactcttcaagctacaattaaattcactcctgaaaatgtttctgaccaatcggtaacttatactgccttgactccagctttagcaacaattgatgaatctggtttaatcacaggcgttaaagaaggtactgcatcattcaacgttcgctcaaatgtcaacacagctgtttcagcattgattgatattgaggtaaagcccgcggggtagtagaagccccgaccgagctttcggcaagtagcgttagcgaagactcagtaacattaacttggaaatagactgcacaaagggggggggcttgggataaattcccttgccctctttttacataacaaatataaaggagattacaacatgattattagatttcaaggcaaagaccttaacctacgattaacatacaagtctatccactttctggagttagcctttgaccaagactacgcttcattcattgctgagcaaacgcctttcaaccagtccttatacatcttctgggcaatgcttcagaacgagtctgattacgaaggagtatccgtactagatgtggcagagcttctccaagactctctggatagctatgagtttaccttagaagaatacttcgagaaagttaacagctcgtatgcttctagtattctagttaaacagctattcaaaaaacaacactggctcgttacccagaggaggcggaagacgaggacgagcttccgaagctagacgtaagatactttatggtgttgtgttcagacttaggaataccttccagcgacttttggacaagtacaccatatgagtttaatggaatgttacgaggagcttaccaaagacaatcaagagaagcttcgttattcctttctctagtgcaatctaagaagcctgttaaattagagaagtatcaaggctttgaattagttaacgaaacaaacaaacctaagactactagggacatggcggaaacaatggatgaacttgatagagcagcctttaaagaggaagagctatctaacctgttcgactactttgactaggaggaaatttaaatggcagataaggaaatgcgaattaaggttagggtagacaactctgactatgcaagtaaaatgaaagatatggaaggcactcagtcacgcttaggtaaaagcactgagcagactacaggaatcttcggtaagttcttcaacaagttaaatggtggggcgagcttagctaacagctctatgctaggacttggtaaaagctttctgtcaaccagtgttggattcggtactctaacggccgctgctactcctatggcagctgctgtaatgggtgctgctgaagctactaaagttgcaggacgctttgcgatggattccatcaaggactatgctaactttgaaggaacccttaaacaagtacagattattgcaggcggtacacaggctgacatggatatgcttggagacacggctattgaaatcggtggtaagacttctaaaggtgctcaagaagttgccgaagccatggttgactttgctaagctaggttttacagctaaggaaacttcagaggctatgaaaggtatcgtatacgctgcagaagcttctggctcaggtgtacaagaaactgctggaatcgtagctacagcccttaacgtatggaaccttaaagctacagaagcagaacacgttgccgatgtcttggctaagaccgctaacgaaacggctgctgacatgcaggacatgggatacgttttacaatatgctggttcatcagcttccctagcaggagcttctctggaagacctttcagctatggcaggtatcatggccgacaacggtattaaaggttctaaagctggtacctctttacgtacagctttcacaaaccttatcaatccaacagacggtgcggccgctgctatggaaagcttaggagtacagtttaaagacgctgaaggtaaggcacgtcctacgatggatgttatctacgatttacaagacgctgttaaaggcatggatgatattcaaatccaagagctttcaacaatcctgttcggaaagcccggggctgctggtatgtcgttcgtccttaaatctaccaaagagcaagtacaagacttatcaaaagcattagtagactctactggtacagctgctaaacaagctgccgctatgcgtgagactatggcaggtcaattagaccaactaggagactctgtggacgctatcaaattaaaaattggtagagcgtttaccgacatgtttgcactagacgctgttaaaggattcaacaaggctcttgatggagtcgatgaaggattatcaaactttggtaaaggtttcaagcgtacaagcgacttattggaaacatctaatggattaatctctggtactaaggatgccaacaagtttgttgaagctgttcgagatgcaggtactaaccttactaacattcctttccaagagtctttagcacagtctcaagtgtggggaattggaatctctaaacgtgcttacgaaaccaatgaggttatgtatcagcttaacaaaagtattcaagagttcagcttcctcccagatgattgggaaggtaagtggggacaggcttcaacaatccttaaagattcagtaggtcaaatggagttgaaacttgcttcagcagcggctaaaggtaagcatggggggagaagctgatatttcaggtatcatgaatcagactatccaagagaatctacctgctttgcaaacagctttggatgaacaagtagcagtattcggaacagctaaccaaagccgattagacgccttgcagacattcttcactaacgagaagactttaactgacgagcagaaatctattatgatacaaggtgagctaactcatggccaacagctttccgataccattcaaactaataacaacaagattttagaattgtatcaaagcatgggtcaacaggattatgcacagcgtcaagaaactggcgccgctataaatgccctgcaacaacagaactctgaaatcctgcaaaacatcgctacaactgagtcaagtagtattgttgaaacacttagagcgcaggctagtagcactgggacaattactcaacaaatggccaatgactctatcgcggcagctaaccaacagtattctgaaactgtagcagcagcctctaaacaatacgttgaaactgtcagctcaattaaccacatgtcagatgaatctatagcagctgctggaacaactagagatgagcttatcgaaaaggcacgtcaacaaatggtcggaacagtagaccatgctaagactcagaaagagcagacagtaggagaaattcaaaagattgccgacaagtctgaggaagttgacggaacgcatattcaaatcaatgctgacgctgatactacaagtgccatggaagagctcggtcaattagctgctagaattaacgacgtattcagagcttttggagaaactgctggaaagattcaaggtggtattgatggatttgaaagtaagcttaaacaggctgataattggatagctggaaaggttggaggaatcttcaaggctcgtggaggacttacttcaggcgttggttacggaatcggcggaggcaatgcccaatactctccaatggctaccgcagtaggtgtcggaacacagttaggacagggcggtatcaatcagggcgtaatccataacgagcgaggaagagaagttacaatgcctatccaaaacgctacttacatgagacctttcgcagcagctgtggccaatgagcttcaagcaatgggaggcggactaggtggcggaggcgttcaagaagttatcgttccattgtacattaacgatagagaatttgcaagagccactaacaaagctatgacagaggagcagcaacgtgtcaaacgtatcgctaaccgagctgtcggcaaaaaagtaaaggagacgtttaaatgacatgttctaataaacctaattacactccgtttaaattacaaggtctagcccctactaaacagtggggcttaggccgttctgctagttatgaacggtttaacccaaacgagtttcacgccttggaggacgaggttaagattactttcccagtagactttagaggaaaggttaaaggaaactctaacccaaacccttcacgaggatttagccacgccagccaaatctaccgtgagaatgttttaagaggaagtcagttcctatctaagccttcattactatttaatggagcagtatataacgagaagacagtctacaatggagctatggttgcttctactcaagaggttaaccaaggcttgatgttctattgggaagactttatcaaccctgacccaagaattaaagaaggtgacatggtaactttctcagtagatgtccgaagcactggtgaagatattccaacaggagctgtggccttcaaagggacttctaactttgaggaatactataaagtccttgaacaacctatcacaaaagagtttactcgaatctcattcacaactcgtttcctatctaaggactgggaatgggacgaagcctttggaatgttctggggagcagagaatgttcctgttacagattacccaatgtttcaatatgacaaggataagttagttggttttattcaggctcaagaaagtgttcaactagagttctcacggccgatggtttcaactatcggaaagactgcttacattgagtctggggacgacatgttctctaacaacaaatgggactggtctaaagccgtatctaaaggtcgtttaaatgaatttgatggtaagtataacacaaacggaatcaaacaagactgggcaatgcctgagttcattcctattttcaaaggctctgagagaatccacttctacaaaaagactaccttaacagaaacaactgacgctggacatggctatggtaaaatcctattctacagcgctgctaacgaagattcttatatgaacgtatataagaagttccctcacgaggctggcgtatatggtggatacgctgctgaagtagaagtgcctattggagctactcactaccgtgttcatataacttcagaaagaggaagtgccactacagaagcctatgtacaatcttctgctaacgactggtcagagtttagccaagagtggtacgatggactgtcaggaaagctagatggaaagactgccagagctgagacgttctaccgtaaagaaatggttgagatggagtttgagctgcactttgcggaagctgtacagaaagctttgccaaacatcttcaaagaccttactactgacgctgagaagcaacaaagacttcgtgacattgcttatcaattcgattcaacaatgattgcacgaggacgtggacaaggcaataacctagctgactggattttctatcggtgggcacctgacggctctattgaagaacaaacaatgaagcagtttagaggagagggattaacttcagttacccatccatctagctaccaagaatggattaatccacagggtagaattgtcacatcgctacgctctaatcgaatcattcctaactcaatgtacatgggaacagatacgttaagtggtaagtacgaccctaaattaacaacgcttcagctggaagttaatggagagcttgtcgataagaaggccgctttagataaaacttctgaagtgtttacatttacaggtcttaaaggattcctaaaaccagaggacaaggttagaatcgctgggtggaataaccgtaacaaccagtggtcaatcacttactctaatgttcttatgggaaacactccagaaaacattgcagagtttaacgagcgtgcctttgttgaggcggattaccttgttacaaacatgtcagtaatcgtaactcaatctcaaatggacgagtggggatttaatcctaacttaccagattatcggatagagtcactagaacgtcctgcaagtcgtacagaagagtacatgataaactctatggtacaggtaacacatgcctatgatatttacggatttatcgaaagcaactaccctgagttttacggagactgctacacgttcgatgacagaattagaaagataaacgaacgaatcaaacagtttaacattgtggctaccacctattcagaagagccttgggaagacggagaccctaccatctacatttgtgctgaggctagaaacccagatagagactacaatgtaacttctgaaataaatcaaacagtagagcttcaaattaacaattctaagggacactttatccatcctaatggttatatctacgtaggattcgctaggatgcctagaagcgaccgagagacaggaatctcagtggagtctgaattaagctttgactttacgatggacagacagtatgacagccttccaagagtcttccgatacaactatcagaagcagccttggttcttgtttgtaagaaacattaacagaagcgttcttgcccctaaagtaaacactctaactcctattaacggaggtactagacgctataactttggagctaccgaagacgctcggtatatctcaatggactgctttatcaaagctcctgctgaagaggatatgcctaagttgatggaagagcttgctgacttcctagacgttggagaaacggtaatccaattctctgataacaaagaccgctactacaaagtgattctggatggttcaacagacctttcccaaacacttcacgtaggtacgttgacactgactttcgtattgcttgagaatacagctattggcgaagaggttgtggaaagctttgacatagacagcacgacaggttcagttccattcattgagcttgagaacatgggtacggcggacgcttaccctacctaccaactgacctttgaagagcctgtaggatatgttgacctaatcggtacagatacctcagccaacgtgtcaattggaagacgtcctaaagatactgaagacgaggttaaagtagaccttcgtcctcgtaagttctatagtaagtttacatctactgatggagctggatggacggctatgaatgatactcaacttcctcagattgaagggtactcaactaagcttcaaggaactgtccaaagagttaatggaatggccaatcaagacaagtggaattacggagacactagccacagaggatggcatggagctggtatcgtagctaaccttcaaaagaaccttgacgacttctatatggaagcctctatcgtagctacaggaaagccagttaaaacttctgctaatgctattttcttgatattctatgacgaaaacaacaacccatatgcttacactaaggttggtacacggcctcaagagggtaacttagacagctacgtagcttacgcaggtgactggggtaaacgtaaagtagttaacaatggagctaagtggaaagacttctggggtaaggtttctgtacagcgcagagataaccgatggagacttattgtaggtcaatacaaagaccgtagatacagtccttcacctgaagcttcattcaactttggtcagaacatgttgaaagacacaagagacacaggatggttcgacttgcctcctgaaacttggggtaagaagtttgcaagggttgggatattcttcggacagtattcacatagacctaaactaggccacctttcagtgcgtagattagtcgtgtgggaaaaccttgaggaatacggagaaaaacctttagaaggaactccaatcctattccacgaaggtgacactgtagtaattgactcaagcaaagctcaagcatatcttaatggagaacttactccatcgctagtagacccaatgactgactggttccctataaccaaaggtgacaactacattggaataaacaacttcaaaggtaagcttgacatagtatataacgaacgatttaaataaggaggaaaaagtatgattacagtattaaacgcaaacggacaaacagtagcacactttgtcaacaacgttagcgaaggagtaccatactttgagcctactttgacggagaatatagagacgttggtatcaacgttctctttctctgttcctttagactgtgacgaaagccagtatctaaaaggcttgaataaagtattagtaaaggataaggacggagatttaagacagtttaatatcattcatacggaagaggttttccaagaagttgactcacgtattctagtggagtgtgaagacttctcaattagcgaaatgaatgacactgtaatctatcctttcaatgggcacaacttaggagacactttaacaaaagccgtaaaaggaactggttggggaatcgagtattctgcggacacttggcaagaaggagaagagcctttcatactagctgagtatacgaacatgcgagaagtgtttggaaacattcagaagacgtatgacgtagactttaaatttacagctgagagaacagccttcaaccaaactaaacggattgtcaaagtgtataaaaaacagaggtcttcaaacaggccgttacttcacctatgacagagacgttttgggaatcactcgtgacgtgcagtacaatacaatcaaaacagccatcctaccttactacacaggagttgatggaaaagtatggacgcttaaaggaatggttcctgttaaccctattgaaggcattaccaaagataaggaaagccctttggtagtccacaatcaagctcatgcagactatgacgaacctttcttcttcaaagcaatgcctttcaaagcttcatcaacaaaccctgagcaagtatatcgacaaggtgtagaagagcttttaaaacacattgccccaatctatacttacactgttaatgtaatccttctaaatcgtgtccaaggatgggaaggggaaaccttagcactcggtgatacagtatggatgaaagagcgtgtaggctctcgtgaaattggtctggaagcacgtgttattgaatacatttatcacgaagacgacccaagccttgatgaagtaacctttactaacttccgtgaaattgacacttacgacacctctgatattgcaggtatccgagacgctttgaacgaccttaaagaccaagtggattctaacacagttattatagaaactactagagagcagattagtaagcttgaagaaggtcagtcaggtatcattgaagacttaggaaacaagaactcaataagcattggtgacacgcctaagccaaaccctattgacggtgacacatggttctctacacgtgttaacgaagctggccaaacaatccatgagattaaagtttgggacggcgttgagaaggtatggaagctttcaatggatacctctaaagccttcgaagcagaggatactgctaaggctgctcagaaagacgctgaggaatctcttgataaggctaaccaagctgtagctgatgctgacactgctaagacagctgctcaagaagctttggatagatacaacaaccttatgataagcggccgaaaccttgcgctaaactctcagaagattactgtaccagacgtagtagcaggaacgacaactcgtaggaaaactattccgctatctattccaactaagttaggcacagagtataaactgaagtttaagtataagcttactgaaggtactctaccagaaggtatcacagttggtatctataacgttcctaagcttgcatgggcttctaatatagttactatccctactgaaggcaaagatgaaggagagctgttcgcagagcttactaccaatgctactgaaggagacgtcttgcttatctatcaaggagttagaagtgctgttaagaatgatgataactttgactttacagaagtctaccttgtagaaggcgataagataggagattggcaaccagctccagaagacgctatcgcaagcattacgaacatcaacggtgaaatcacttccctagtgactaagacagatggattggaaacaagctatagccaaatctcacagacggttgatgaaatccaatttacagtcggtgacaaagctgataagagtcaaatcactcaacttcaagaccagattaacttacgagttgagaaagacgatgtaatcaatcagattaacgtttccacagaaggtattatcattgatggtgcaaaggttcagattacaggtaaaacttacattgaggacgccgttatcacagacgctatgattagtggcttatcagctactaagttaacagcaggtgttattgacgcttctaaaatcaatgtaacaaacattgacgcaagccaaatcaaagcgggtactatccaaggtattgacataatcggttctaagattactaacccatttgaaataggctcagaaggatatacactagctggtcaaactgttatggaaagagcgcaggttaaaattgactacagcgtttcagaaactggtcaaaaaaggttggtcaatacttcatgcaagaggtattcaaaatcagctacttaacctagacggtactattaactcgttttcatctcttgcttcagatggattatctattcaagattctttaggaaacagtggttacttatcagccgagttgctaatgcagttctctaacactggtaagaagatttaccccggaaattcatgggtaactaacactgatagaattgtaccctcattgacaatgaacaaatgtgctattggatggctgttcttatggcaaccttacgatactactggtggtaagccttatacatgggactatacttactatttagttcctaaagctcatgctaactttaacagtggtaaaggtattaatatgcggctacaaggcgcaggtaaaggtggaggagcagatgatactgtgtataagtatgtatacgtatctaatgactctataacaggaacggtcaataacggtactggtaatggagctaaatgggttcttaccggcgtattttcagtttaaaggagggattattttgagagtttggattgaggataaggtaggattattgacaggatattcaacagagcctttggaaggctataaatgtgtcaatattgacccttcagagtctttagaaatgcttggaggaatgcttgactttcataactattactatgatggtgagaaagtatatagagacactaacaacgactttcagaagttcttagaagaggaagcaaacaagcctcctgaaccttctaaagaagaaatggaagaaagacttgctaagttagaggcacttttagcagacttgctataaagcttctgggtgggtagtgggaataattttagaaaggagattcatacatggttaaattaaatgatgtacttagctatgtcaacggacttgtcggaaaaggcgtggacgctgatggatggtatggtactcaatgtatggacttgacagtagacgttatgcaacgcttcttcggatggcgcccgtacggtaatgcaattgccttggttgaccagcctatcccagcaggcttccaaagaatccgtaccacaagctctacacaaatcaaagctggtgacgttatgatatggggcttaggatactatgctcaatacggtcacacaggaattgcaacggaggatggaagagctgacggaacctttgtcagtgttgaccaaaactggattaacccaagccttgaagtaggcagtccagcagctgctatccaccacaatatggatggtgtctggggagttatccgaccaccttacgaggctgaatcaaagcctaaaccacctgcaccaaaaccagataaaccaaatctaggacaatttaaaggagacgatgatattatgttcatctattacaagaagactaagcaaggaagcactgaacaatggttcgttattggaggcaaacgtatctaccttccaacaatgacttatgtaaacgaggctaacgaccttatcaaacgctatggcggaaacactaatgtaacaacctataactacgataactttggattggcaatgatggagaaagcttatccacaagttaagttataagcctataagaaaagccccttggaaggttactccaaagggctttttattttacatctcaaagcattgtttaagcttttctaaagctactctataagctagcctcatgccttcacaaaagtctgaatcctcttgttcatattgttctaaacgcctattcaaaaaacatgacaacctcggccaccttctccttgttaatggagtctacagcctgcttatgcgaatcttctttaagctttgccatgtcctttaaccgcttagtaatatcactagcgaagtcctcataatacttgtcaaaatcaccttcaataaatgatactggaatcattccaacagttatatcagaaggttctctataggcgctaacagtcacctcgaaaggctctgtcggaaggttacctatagttatcttagaacagtctttggtatctcttaaatagacatgtggtacgtccaacttgataaagttatcattacgatagtttaaaataggtcaacaacctcctctaaggcgtactcagtttgtggagtagcctctgatactgctttctgctcagcttttttctaaagctacactcatgaatcgctccatgtaaagtagtctagcttggctgtaagaaagcgttgggtaacgtgagtttccgtgataatctttaatggccatctctaagaatatcttcaaggcttctgcaccgaagcgctcaatatccttcttcatgattgctctcaaagtctgtagtgaagcgttgataggaaccttcccaaacttctgttgattaaggtatgcaacatactccataaaggtagtagtattccacatagataggggagcgttcttccaatcctttgtgtcaaccttgttaccatcggcgtctttataaagcttgttctctttagttctaatccatgccatcttaaatgccctcctcaataaattcccacacatagccattatgttgaatataaactcctctacagcattgtgctatagttgattcgtcaaaccctgccctgtgagcagctttcattgaactgaactcaattacgtctccagattttatattggttgctctaacaggtttacttatctttttagttttacgttcaatagctgtaccgtagttagaattatatttatgagtacaccactccaagttactcaccttgttgttttttgggttttcatccttatggttaatgcaaggtaaattaaagttattaggtaaaaaacgcttctgcgacaactctatggacatgcctcctgtttcctctacctaagtttacaactaaatatccattgcctttatcagttaactttaaaattctacctctatgaaatctcgtaaatgagccttttttctgaatacacttccctgtccaaacttctaattcttccaagagaacttacttcatagtgtgattcaaaacctacaacaggtttccaaacttccataataaaacctctccttaaatctttgataaatccatcatagcacatgattggcggattgtcaatacattttgtatagctttcacgaaaaagtttcaaaggcgactgaaaggagtctttaggctgtgagggaactttccgaacacctttacactatactatatgccatagctatccttaaaccataagaccttacggcctttaagttcaagagcagcttcgttaacactcagctacaacctcctaaagtcggttgtgaaactctttagtaaacttctctttctctctttaagacccctaagaccagtatactaaaattaccatttttttgtcaagcgattttgcacaagaacttttgtggagttgttaattgtaaggttgttgaaacatttgtaacaaaactgtaacataaatatttaataagtgttcaaaattacttgactttagctatataatatgctatactaatgaagtagtaaagatgaataaagaacttattaggaggaaattaattatggctaaaggtttagaagcaatcgcacaggcagcgcaagcgcaatcaaaaggttcaggagagcagtctaaaaagacttatcttaaaaagggtcaaagcattcgtgcacgcattccagaagacatcttagaaaacttacacgtaaaccaagtcgtttcagtttttgaaccgcaggtgttaccaacattatcataccatgcagaaggacgtacagacgttcgtgacttgtatcatgaagctactgaaattatgttagcagaccaccgtgctaaagttgaatcaggggaaattgaacgtggttctcaagctgacaaagactcatataaagcagctcgtatcttaactccaaaaccactcatcttattcggtgtaattcctttggcagacttcacacaaggcactaagaaaactaatacttacccagctggggagccaatcttattggaaactaacttaggacgtgacaacgctaatatcgacgccttaacgaacttcttatcaaaagaaactaacgctaagaaattccctaagaaagccttcgagattacttgtgaggcagctaatcgatacactttcacaccgttagacgacgaagatttaacgcctgaagaattagaagtatttaaagctacagaaggcgctacagtccctgaagaagatttcgagaacgcaatctttgaaagcactgttgaacgccaaattgaagacttgaagaaaattggattcgatacaactcgtttaccaaacttacctacagctgctccatctcctagtcaaggcgctgacgaagctggtacagtagacccttcaggaatcgatttctaaaaactatatgaggggcttcggcctctctcctattatagggaggacaaaagaatgaagaaagacaatccacaagttaatccaatcaagtttaccgaagaggattacttccgcctgttacaaacagtcgttatgactaacactttcattggctctctatcagctggctaccaaggtaaggaacgcttagagaagattactaaaatcgctgagaacatgttcgtgctcaatcgtttaatggagtcagccgaaagcaatggagaagactggggagacgagatgttattagactctctatactccgactcagaagttcttgtaactaagtataaacacttgttatcagaagctcaattagaatccataaataactctattaagaactttgcagaatcagctgagaaagctcgcaaagaagcttacgaggaaaaggtagcacaagctgaagttatcgatttcaaaaaaggccaagaagaagcgaggtaagtaatatggaacgcttaatggttgttactaaaatcatcgcagattttttctgggaatagctttgcaccacattccattgagcttgtagacaacttttacgaagacgatttccctgaaggagatatgcttaaagaagctgtgtcagaatcattgtggaacgcagcttatgaaatccttcatacgacaatggcaacggctgataaggttatcgctttagtaactgtatacaacgcctctaatttagaagaatcaacctatgcctacgaagccattcaagacagcgttaataaggctatctgtggcggagctgtggaggacgttaagtggaaacagttcgtgggctctcttgacagtgattataaagagttcttcgagaaggtataagatggattacagcaagtttaaaataggcgacacagtaatgtatcaaggacaactctgcggggcaggtactgttatcaacggcaatacctatactgtcgtacagcttacctcaaagcctcgctatgcctttatcatagatgagcacggcaacaagaagctaatccaaatgggtttcaacttcgctaagataaaagaagcttaaaaagtgttcaaaaacgcttgacaaaggctttaaaatatgctatagtattaaatgtaaggcggcattactatggtttgtcgtaacatagttcgagatgcttctcggctatagcggtctagggctacagattgctcccgcctgcgggctgctgtaataggcagtaaaaaacaatagcaggagtacccacccttgagggcaggagagggcgtagcagaggcggtgacgactgcctcgttcatgcgttgtaagtgtaacggctgcacaatggtctccaaaaccattagagaaggttcgactccttcacagcgtgtttcggggagtatcataattggaaaagcttcggtcttgaaaaccgataggcgtgtaaaagcgtttgggggttcgagtccctcctcctcggttcaaataagtcttatggaggtttgtggaatgaatgttgaaagtcgaaatagcgagaaagcatggaaccgtgccattgtgaaagctgagcaggaagctgctaagaagaagatggagcgccttgctaaaatgcgtgccaaaagtaaacgtaaataattccataaagtaggtaagatggatttcttatctgctattacataagggaagtccccgactgcaaaggagagctagctactcaccaaagcctcgcccgacatccctaaccagtcagttagcatagtttaggttaatgcacaacagtcttcctatagcgcttgtcggaggctgattgggaaagtggttcgaatcctctactggcgccttacatacttcccgaaaagcacttcggacagcgtctggaagtgtacctaggagggttggtaaagggaacgctcaataatcctttactgtaaagcttatttccgaagcgtgctaaacgtcttggagcggagctacatgtgattcataggaggtcagtagcagtcctcagctaaaactagctacactcgtgatggaaggcgaggtaagcgccttggccaaaacattacccatggtggagtaatccacttaggagagcgtcgtacgacaaggtgtccagccacctaaactaagggttgagcattaatgaacgctgttaaccaaggcctgtagggaggtcactaacagcgcattagccaagaagtccagagtagctccctagtgaagtcttctgaagctggagttggctaccagcggccacgctcagggagcatcttagagaagcggttcgattccgctccgtggcattggctgtttatcagctcattctaaaaacctctttcataaagaatcacctcctttcgattagagcagcttaacggctgttcttttttttgttaaaaagtccttgacaaaactttcaatacgtggtatgattaatccatcaaatagatagaggagagatttttatgaaagacacagtaacgatttctaaaagtgagtatgaaagacttttgaaggcagaagcattcctagaagctttagaagaagctggagtagataattgggaaggctatgctatggcatttttttgaggaggaggatttataatggttgaaaagtttgtagcaatccgtagcaatgccacagagaagattatgtatgatactgaggattggttttttctggagaagcaattcagaatcgttgcattgtaaaagtattgagtacattgacatgttccagtgtggcgaggaaggttactataaagtagtgtttaaaattaatgaatacacttacgaagagcatttaccagatagcgcttatacagcaatcactctgattaataaggaggaagaataaatgaacttaggacaactactagacacagtggaatatggtacaagagttaggttagtatattataaatcaacttacaatagtgatgagtatattacaacattcgtaatgtcagacacacttgagtatacaaaagcatatgaattagtagaaccacacattgaaaaaagaagtaattataatctatgttacagcagatggaaaattatgtgttgaaattttataaggaggaagattagtggaaactatgtacacagttatttataagaatgctgtagaaagcgagccagcacttgaaggaggaagcttcttaacggacgctcctaaaactgatggattaaagcttatgacttttgggacaagggttttttgaggtggagtttattgacaatgcggagaagaaaatctacgcaattagaattagataaggagtggtaaatgtgtggaatcagtggacactttattggacagacagagaaacaggtgaagaaggcaacttcaagattcctagacctaatgcactgtttattggaatgcctatcgacattgacgaataccgatacactgtaacagctgtttcaacccctactaaagaggtttggacagagcgtattcctttcgactttggtactaaaccgccttgggaacacaacaattaacttttaactggaggttttttaaatgcttgacacgatacacttaacaaaagacatacaaatccatatagacattcaggagtacctagagcgcttcgagtggaatcgtgcaaagtggactgaagaccgtctgatagctgcttcaccgtttcgtgacgacaatcatccatcgttctttgtaaactataataacgactgggcaggcacttggggagactctggtacaggcgattcaggtaacttcatacagcttgtagcagagcttcacgaaacagattatgaaacagctttagaaatgcttaaagaggagttttggattaagccttacgaagctcctgcaatatccgttaagctaagtgttaagaaagagaagtcaatctttgatattcctactcacaacacttctaagtaccttttaggtcggggaatatctaaggatacacagaagctttacagaacctctgaggacgagagtaaagtatgccttccgtacattaatggaatgggattagcaacggctttaaaataccgtcgaacggataacaaagacttcttttacgaagcaggtaacaaccacttgaagaatatgttgtttgggtatcatgtgatttacgaaaagcttccaaacacgcttgtaatatgcgaggcggagatagatgccatgacggcttatgagatgggctttgttggaatatctctaggagcagctaacttaattgagcgtcaagtagaccttatcaaaaaagttgacgtaaagaatattattataggcactgacaacgacgaaaagggaaaccttgctgctaaatcaatcgacgatgctttctggaaaacccataagctattccgttacgacatgccttctggatatgatttaaacctgtattggcaagagttccacaaggcacctccactaaagaaaataagtgaacctaagttgcttagaagaaagctttggtatatccagtaataaacattagaaaggggcttgacaaggcctctttttttatgctattttataagagtagtaaggagatgttaaaatgaagttgaagaattataaaaaaaccttggacacaagaagacattgattatttagcatggttctaccagaacccagaagaaggctctattaaaagtgtggcagagttcttgggaaggactcctgaaagcgttaaagccaagtattatgaattacgcaaacaaggcttgttagaatatccgtcaagtattaataagaagtggactgaagaagagcgccaatacgtgttagacaactatgggaaaatttctaataaggaaatggcaaggaagcttggcgtaaaaactagccaactaattcagttgaagtggtaccacacccataaaaaataaaggcaatgaaggccttgacaaatagttacaagtgtgttacaatagtgaggtagaaattttttaggaggattcccaatgagaaaacaaacccttttggaaaagcttaaacaagttacaggaaagacagaaaaagagcttaatccaaccctctcccatatacatatccaattatgtggaggctcaggaacaggcggtaaatttggagctgccaaggttccttacgactattcagacaacttcttattcaactctcctgcgagagatacccagaaggatgtttataaacagttagaagtttatgtagaaagcttcaagagagacttccagaaggatggcaacatcaaccaagatgaacggcctataaaaaaatatctatctatggagtgaaaataaaggtaatggaaaaaacttccacagcggctgctttactgaacgagtatatgttcatgtcttggcaagcttcggtaatccttaaaacaaacatgaaacagcctcctgcgtacttcttagatgtgaatagtttccaaacactttacaacaagtttactagaaacggaatcgcaaaagacattgcggaaaagacttcacgagagtattacgaaatgatggagttagcagaaacagctccgctagtagtatttgacgagattggtaatcggagcgctacagaagctttccgagctgaccttcacgacatcatcaataagcgtatggtcaataagcttccatcaatctttacaagcaaccatccaatcgagtatcttgaacaggtgtttgatgaacgattagccgaccgtgttagagagcgtacgatggtttacaatttcaaaggtgaatcacacagaggactttaggaggaatttgaatggcttcaattacagctgaaatgctattatcaaaagttataaacgaaaatgatgtacaggcgttgaatcgtcacggagttagcgaagacctattccaatctcctattcacaaagacgcttacaacttcattattaaatttagtagagaaaacgaaggtaatgcaccttcttatcaaactcttttacaaaaggttccagaattagattatcaaagttctacagaagagtctttcacaagccttacaaaaagcttgaagaactctcgtttacaagtggatacagcagctttcattaacaaggacttaggagagttctgggaaaactcagttaagagtgacgacccgacggagtttattaaccagactattgcagctttagaacagattaaagcagagcacaacgtaggaggagcttcaggaagacgtttagagaaagcttccgaatggtatcttgaagagttctacaagcgtaaagaaggcctttcagttaagttctgggatagccattttgaaagcttaacagaacttattggtggaggctatcaatcaggtaacgtatacacatggtatggccgctcaggccgtggtaaatccacaatcactttagtggaagctattgaagcagccgtgcaaggtgctaacgttttaatgtgggttcttgaaatgcctaagtacgagtttgcttcacgtgcaatctcctttatctcagctcgtgacgaagttaagaaaagtcgtatcaacggttctgactacttggcaggattcaacattgccaaccttactcaagcaactttcgatacagccgaagaagaacaagactttgtggatttcattaacagcttaaacgacaagttggaaggctctattacaatccgagcagttgatgatgaagactttatgaatcgctcattgaaacagcttgaaagagacattgtagaaaacggtgccgacgtagttgtaatcgaccctttctactacttgcattatgagaagaacacttctaagacagcaggtggagatgcttctcagacatctaaggcattacgccttttagcaggccgtactaaaacagttatccacgctatcacacaagcggaggaagactccaacgaaaaaaggcggagacgagcgtgaactaaacattccaaaacggtctaatgttaaaaagactatgtcactacttgaagatgcagcctatgtattagctttcgatagttgcgatagtcgcttcgctgtagaggttgttaaaggacgctcaggcaacgaaggtaagcaggtagaaggtatcttcttaccagttattggatacgttgaagaaagctctgacgaagctgtcaccgatgtttttgaaggtattgaattttagggaggaatttacatgattatttggtcattatttgatagtggtaatgggtgttattcgcaagtttttagtgaaaaggaaggagtggaaaactatagtataggaatggataaagagaaaggtactagcaagaaccaccttaatttagatttggcagatatgagtggctatttcggtgaatccaatatgattaaaagccttgagaatttacctaagcctgacgttataatagccagtccgccttgtgagtcatggtcggtagctagtgcaatggccggtggtaatgcttgttggaatcatcttaaaggagaccctttcactatacgaacatcaaaagaatacgaaagtgttcaattcaatcatgagaactcgttttataatagaatgaacggagaacttacggtatttaatcttattaaaattattaaacatttccaacctaaaatttatataatcgagaatcctgcttttggaaagatatgggaatacattgataaggtattaggtttttgagctggagtatgagaatttaacgtattataacaactacggatttgaaataaagaagcctactaaatttaaatcaaatattaatttaaacctaaaatcagaaaatgttaaagctggcactgaatttagaaaagcctctaggataggtggctcttataatgtacgctctaatatacctttaaccttgattgatgaaatatataaacgaattgaggaggaactgtaaatgagcttttatctatcgcaaatgaacaatcttaaagaaaagattcgttatgagaagacttctgttaagcttatccgagaaagcattgagcggattggaaagcctacaggagaatattctctaggttatactgacgctttgaagatggaattactaattcatcagaagatgttagaggatgctcagaaagaattactcgacttggagaaagagcgcaataaataacaatagtgttcagaagggcttgacaaaagcccttttttgtgttatactaattgggtaggaaggagctaaacaatgacagcaactaaggaactttggaagcctttagtgtttaagggaatccactcagatatttacgaggttagttctgaaggtttagtaaaaaaacaagttgactgataagttattaaagccccaagactctggctatttacatgttagaatccctcttgaaggcaaatattataatgcaagaatccatcgaattgtagcagaaaccttttgcgaaaggcctgctggctgtaatgtggtcaaccatatcaacggcgataagaaggataatcgagcatctaatcttgaatggattacccaaagagataatgttatccactcaataaagttgcgtgaagaggaatctaaacacctctcaatgatagagaaaatggacatgcttctggaaaaactaattccatcacctgaagcaaaatataatttcatggaggaatatgtagaatggctaaagggctaacagcaattaataaagcagcaggaaagactctggtagatactatcgcagaggactttaaacgacaattaaataagtggggagaaacaggctatacatacgatagcgaagtccaccaccagcttatgagagactatcttaaaatagttgaccgaaatcctttcgaggactttccagaaaacgttccagtattccgttcaagtggaactggtaaatgtttaagagagcagactctattcgctattgataagattgagggaagcgatagaaaagaccctcctaaaatgcaggctcatcaaagccgttgggtacagattggtacaaaggtcggtgacatgattcaggagcaagtcttgatgatggagaagaactaccgacgctttactggggaggattgccacttccgttttgaacgtactgaagaaggcttccctcactttgaggagttctcaactacctttaaaaagtataaatcaggtcgtatggagttcatcacaggaggctctatggacggtattatgatttggactgacccaagcagtggagaagagtttcgagtaggccttgaggttaagtctaagcaaactactccagcagctactagtgcattctctatgagacaacctaactcaaaacacgtttggcaagttaagaactacgccatgttaaaagacttagacctgtatttaattgtgtatgtaaactgcgctcacaagtcttgggaaatggctgaagaagactatgcgaagaatccagacttacaagtattcggtgtaaatattaccgaacaagataagaaagacgttcgcaaccgtttcttcacagcgattgaacatgctcatgcaggaacgcttcctccattagagcttagcggatttactttcagcgactataaatacgccttggcaaacagccttacttataaggaattggaagagcttgagaagaaagccgtatctaagtttgaccagaaggctttagaagaaatcaagaagattagaggagatgttaagtaatgaacgaaagcatttatgaaggcattccagaagacatcttacaagagaagttctatggagtgtttattaaattccgttgtgataatcgcactaagcctctggcaatgcacattagtgaactttctaaggaaatgttagacgcgacttatttacaacgtgaagcaggcgaatctaatatcattctaaaagacgttaacacaggtcttgaaatggcttttgacttaactgatattgtagtttactccactaaagagattgctttaggtgatacagaagcatattatagtttcgctgaacatatggctgatatgatgttaggagatgattaaaatacgctttattagttttgacgtaagcagcgtttcgacaggcgttgcagtaattgacagagagccttctggataccttaccttagtccatacagacatcattagcacgaatcctaaacacaacgtaggacgtcgcttaaaaaactttgcagaagctgttcaaatccttcttgaaacgttccgcccagactatgttgttaaggagcagacaatcgctaggatggccactcaacacatcttactgaagtttgctggagtgcttgagatgatagcctctaacgaaggattcccaaagatttacgaatactctcctacgactgtcaagaaggttgtgggaggccatggaagagctacgaaagaagcagtccttatgggtactacagaatacattaattggaacgagccaattgaccttgtaattgacgacattagcgacgctgtagcaatctgtctaactcacattggaaaagagtttgtattggttccactaggggaagttgagaaagctaaagaagaagctatgattgtagaggcggaggcttctaaatatcttgaggaggctaccgaatgaaacagcagttgagaattgccataacaggaacttctaggagtgggaaggatacctttgctcaagctatccagaaaaagttagttgaaatgggctttgcagaagctatgccgatagcctttgcagaccctttgaaacagctgtataaaagatacttcttctatatggaggacaaagagaagccaagagacgcttatgttaccattggaaatgctatgagagaggttaacgaaaacgtttggattaataaccttttaatacaggctgccaaagactgggacgaaggcttctcaacactagttacggacgttcgtttcgagaacgaggccaaaacacttataaacgattatggatttatcttggttaaggtggatgccgaccctcttattagattagtccgtgctgaagctttaggtgaaacacttgatttaaacaataagggagacattgaggtaggaatgattgagcctcacttgaccttcataaacaatggggagagcgacttaatgcaaatggacaaatatgctgaaataattattaatatggctcaggaggttgctaatggctaatctattaatctctgagaaatcatactatgaaaagttagtagaagcggaaacagcaaatgagttccgtatggttttaataagattgattaatagagttgttatgaaagttaaagtaccacttgaggttagagagctttttttgtgaagaggttttagagatgtattacgaacgctttggcgacgtagcattgccagatagcctagcaaacatcctctcaacatattatatgcaagacgatactagaggcgatttggaaggcactaacaagttcgctcgctgttctaaaatggagtatagctttgcttctgataaaaaggagaagcgaatccgtactgaggacttatataaagaatctccaatcaacttagaagtgttggaaggaaatggttattcacgaaataatattgcctcatcattggatatggagcgagcagctcttagaactgacttattaaaggctatggcaaaagcagatttaactgagatggagaagaaagtccttgagctaaatcttatctacgattacactatgcgtgagattgaagtgcttccagaaatgccttcaagaagcaccttgagtagacaccttacctccgctcgcaaaaaagattatgcaacaaatttaaaatactttcaaaaaggggcttgacgaagcctcttttttgtgctatattatattcatagacaaagacaactaataaaactacttggaggaatatataaatgcctagaacaaataataaaatcagccgtaagaaagcgttagaagtgtatttagaagggagtaatccattagcggctatctcagagctaattgaagagcatacttggacagttggtttcgatatggagtcagcaaccttttataaagagcgtacaagcaatccatacgacacctgcaagaatcctcggtgcaagctttgtaaacagattagagaacacgctgaacgaatccctgcttactctttaggcaagactttagctaagcctttcgaggaactttctttagggcactttggtaagctagctgcgaatgatgtagcgaaatcagatatgccgaagcttctgaaagtttctatgaaagatattaataatcatattgaaatgcttgttgaaaaaaattggattagacaattccatcaaccttctaaaagactacgagttatcagaacaagttatccaacagcttttagggattggtgtttatgatatgcgacaatttaagaaacgtatgtacgaaggcaagaagcaacgtattgccgaagctaagaaaggtgagtgggcttaatgaagcaatatataaagataggagcagccattttgattttgcttattggagtagctgtgtggttaattgagtttatactgccatttgttttactaaaatgggcattgtagaaagggagggattttagtatgggacttttagaaagaatcacatacagcttatttatagctttggtagtagttttagcagtaggagcattttttgtaggtgtttattggctagccgtttggactagtggattaggaggccttggaaccttcgttgcagtaggtattgtaatgttcgtttttacagctttagcggtgtttcttggatttgattaaggaggaattttaaatgaaattgaaagacttattagaggtagtagacccaatgcaggacatctctttggagattgctgaattaacggctccagaaggtatttatgctaaggatattcaaaagcttcgtccgatggctgtggaaatggaagttgtggacgtccatactgcttggtatagtggtgaagacagcatcgaaacaactttaggagtcgttgtaacagggggggtaaaagtaatgcgtaaactatttgaagagaactttacaattgacgaaatgtcagagatgtggtatggctgggataatgaaggccttttatacggctgggaaaatggagaagctggagaagtttataatatacttgaggaaaatggttataacatggactccattaaaattatgtatggggcattcgtaacacttggtgaattggtaggtgcaatttaggtatgcttattagagtaaacgaagctgagggaaacacttcctttatcgaatatattgagctttcacagtcctatggaggaaagattaacatagagcttttttgtagaggatgttgaggaagacaatgcctttccagcaagtgaattttacatggatgatgaaactgtagacaagcttatccaagcattgcagagctttaagaaaggggaaaactaaatgtctttaggaatgtttgacaaagagcttttagcagctctagcagctttacgatgggttgtagaagaccctgaaataaaagagcgccatgatgaaattttaaacacagcgtacatggaaaacgcctatgagaaaggcgactcattccctgatgaaaagtttgtggaatgggatttcattaacgccttaacaacatttgaaatagaggcggctgcacgaggccttattactgatgatgaagcctacgatgaagaagacgatatggactgggcaagcgacacctattcatgtggctgttgcacatgctgtggatgcacctgtgactactatatgtgggaagatgatggaagctttgacgaagacgatttggaggactaattgatggctaattattacgtgttaaaaagacttgacgacggttcaggtaaactccatcaagtcaagtgttacaaaagcttagacaaagctattaaatacgctaaagaaatgagcacctttaaaaagacttaccaagtagctgggcaattcgatatgaacaggcttgctaacactggtaggctaatttagaaagttgtacgagaggccttgacaaaggtctctttttgtgttatagtaaatccataggaaatatttaggaggaagattatatgaagatttcagtagacttacctaacgaagataaagcaaaggcggctattaaaaaaagttaaatgcaataagcctttattaacaatggaagaagcttgggcaaaaaatcttctcaatgaagaactctgctaaggataaggagcgccttaaattagttaaggaataccttgaagaaggtaaggtaagccgtgaggaagacaaattaaacaagaacttctcaaaggccgaggctctacgtatctaccaaaaggttcaagaaatggaacgagaagctaagtttgacgaaatccgtaagaaagagtggaagaaattccctatcataaacaatattgtagagcttgctagttggattgacaacgctcttgaatgtgataatgaatacttggcgatggactttgaaacggtcggtgacaatggtggaacagacatgtatcgtgaagagatctcaggattctctttaacataccgttataaaggtgaaatcatcaatggttacgtgcctatgcgacaccgtgaagaagatggttctccaagccatttgaatatcgctaacgtgaagtgggctgaagaaggaattaagagagtctttgagtcagataaggcaacagtatggcataatgcaaccttcgatatggggcttgctaaagcttctttaggaatcgctcctagaactcctgtccacgataccttaatcttaatgcaccttcttgatgaagacctaccaagctaccagttgaaagttttagcaacacgcttcttgaatattccatcagatacctttgaggaaatgtttggaaagaatgctaagtttgctgatattgccgttgaaattgctcgttggtatgcaggcaaggatacctatgttggattcctcctgtttgaatggcagttgaatatccttaataagccttcatttgctaagattaaaaaggtttatgaacggattgagcggccttgcattatggccacttttgaaatggaatcagaaggctttcacattaatatggaagaggttgaggtacagcgtaaggaaagcgaggcagagttagaagagatttctgcacgccttcaagcacgctttggagatgttaacttcagctctccatcacagcttttaaaattgctttacgtagacaatgattggagtaagtatgttacgcctgaccacaaatccattctaagaggccatgtgggctataatgaacatggaataagcaataacaaattgtttgcattaatgcctaacggaagtgttatcctagaccctgttgtgaacgctgaaggaaaagttgttcctaagaatgaccgaaacaagttacaagccaatgctaaggctatgaaaaaagattgccaaagctgttgacgaggttcaggacatccttgactacaaggatttaacaaagcatttgacagctttcgtaaacaagattgacaccttcattgcgcctgatggaaagcttcacggacagtttaaccagttcggtactgttacaggtcgtttcagtgcttctaatccaaacttacaacaacagcctaagaaagctcgtaagatgtttgaggctccagagggctcattaatccttggtgctgacttctcccaacaggagccacgtttattagctcattcaagtggatgtcaagaacttattaacatctataatgaaggtcgtgacttgtattctgaaatggcttcagcaatctttaataagcctatcgaagagtgtttagacggctccatttaccgtaagaataccaagatgattgtccttgctatcatgtatggaatgggagcttacagccttgccgacatccttcgtatcgacgctcaggaagctcagaaaatgattgacgacttcttcgttgtatatcctgaagtagaagcttggattgaaggaaataagaaaacagttgttaagcaacgctatgttgaaacgctattcggaatgcgtcgtagattcaagcatgaaaacttcgacatccttaaaaaagaattggaactccttagatgaaaatgacaagaaactccgctcagcagcttcaagagctttacgacaagctaccaatgctttaatccaaggcggtgcagcctctcaaactaaactcgtaatgaacgctgccagaatccgtttaaaagagttgtcagaggcacgtggagagcctaactcatttggattccttgcccaagtgcatgacgagctgttatttaaagtaccagaaaacgttacacaacaagaggtagacgctatcgaagacgttatgattaacactgtgaaactagtagttccgagtaagactgatattgagattggtaagaactggggtaaaatgactgctagaaaagattggtttaaataaactttggaaaaggggttgacaaacctctttttctatgctattataaatccataaagaagagggaggaatcttttatgaatagtttatatgaacaatttaaagagggtactttaaaggaaggacaacggttttctgttacaggaacaattgtattgattgatgcagaagaccctgcactacctttaaaagtagacattgatggagaaggtattaaatggcttaaagaaggagctattaagtatatggaaccagctgccgagaagctgtatgaagtaagtatcggaggccgcctactgagctattacggaagcgattatgaagaagggaaatggacatgcttttttgtggagaagtagagaagaacctaaagacatttttgttcaagcgtttcctatgagcttcttagaaaaacatttcccagaggttgttgaaattgctaaagaatccaataaagaagagggaggaaatgccttatgaaaagatttgcgattattactagaattgaggaatgcacgcctgatgaagacctcttagaattagggaaggcttacgagattgtcaatgaacttgtcggaggggctcacgtatatgttgacgaaaggcataagcgttactttgtagacagccatcaatacgtagaagtagctgaaggaatctttgaactaactttaggaatgcttttaagcaagcttgacgaagatattaacacaaaccttgaaattagttttgaaggtagggctaccaaaattgtttcggaaaactattacaaagacgaactaaaggattattttgacagagaggtaaaatggtattctccagacactgtggtagatggattaagtattcttttggaagggggagtttagcaatggaaattaaagttgagcagcctaaagaaatccttttagaagttggttggagatacacttctgactggattgttaattctaccacagtttcagtggaagataatgtatatgcctatgagaacgcctgttacaaagtccttgaagagctttgtgaatccatcgatgctaagtatattgacatctgctttgtaagggaggccaccgaaaatgcctaagaaatactatctaaaagctatttcaatgtatatactatatgctttcatagcagccgttattatcggtggaacattcctgttagtaggagctttcgtatgggtaggtaaatacgtttacggaagatttggggacactgttggaacaattcttttcctctccacagctggactgatagctttatgtacagccctttactatgaagctagaaaagagttccgaaaagacgctttgagagtccgtatacaagaccctgaagacggcatcaatacgcagagccataaaattgtttatatgcttccagaagacgttatccgacaagcctcgacaattgttggaattattccaaaagacatacaacatatcgagtccgaagagcttcggaaaaaaggttctccatgccatcatgaagtattcaccagtggagtatggatttacgcttatcacagagtatgacccagaccgtaattttatgcttcgtgaaatatgggatttaaactacactttcaagactagaggaaagcttatggaaaagcttatagaccgtggagtaggacttgatggagaatttttgaagtatcttgttgactaattaattaaagtgtgttatagtagttttgtagaagacattaaggaggagattttaaatgaattacgaagagtttaagaaagagattgaaagcattgactatctaagtgtagagaacagatatgatagagtgcttgtgtattcttcattaggcgattatccacttgtagcagtatctattttagagacaggttttgtggactataattggagaggccatgttagggcgcgtgacattcctgttttaacagaagcagtagaaaagtttgctgaaactccttatgaggagcgttttccaaaaaaactactacctacttattggagaaaactatgttagtggaattactttcacatacccatggttatcagctgactgtgagcctgaagaacctatcgaagtaactttcaatgaagcttttccacacttgtttaccaacaggaataaagaacaagcttctaaaatgcttgatgctgcaaaaattaaacatacttgggaggtagtttaaatgaaatacactaagaaagaccttaaagaaggcatgaaattgcgtgttattgacggagctggctttgattttttgggaagaaggctcagtacacgaagtaattaaacgcaatggaacacttattattgatgacgacgatactcttggaagaggaattagaaacagtgatgacatcttaagttatctaaatttggaatatcctgtaaaaaatggaagtagtggaggaaggcatcatgaaaagcactggggaacgcataactagagataatattaaagaaggcatgaaagtagtgtgtgttaaaagcatttatgagtcacagggatactttactgttggaaaagagtatgaagttgtaatgggtaactgtggctacttaggtattaaggataatggccgtgatggatttatctgggattgtgcaatctttaatgaagacaagtttgtcttcgagattttggaagagccttcagaaaaaagcttctttaaaagctttagaaagtaaaattagagagcttaacaatcatcagcaagagcttttccaaaagcgtgacagaatcaataagcaagctatccaactaggaagcaaagcacgccgtttagaagaggctaaagcactaatcgagaaatacatttaggaggcagtcttatgaaagatttttctagtagtcgttatgattggcaataagatgcttaactttgctacttctacagaagccatgacaatggagtttgtggaaagccttaaaaaaagagctttcagaacagcttagcgaagacttaacacctgctgatattacagttttaaatatcattccaatggataagaaacaaagtagccttattacaggcatttaggaggagtttacacatgttaacgacagattttattaaggcggtagaaaagattgggctagaggttgataatagctactcttcagtgctttatgtagaaagtcacgatggcgttgttgtaagtattaacaaaggctgttctgaaacttttacatggtgtaatggaacagacattcatgtaggaagccttttagagcttatcccccttgtggaagagtacgccaacacgcctatcggagagcgtgagaaaaaggtttccgagaagcctttagagtcctacccaattgaagagttgggagaggctatttctaaaatcctattaaacaagcataacccaaacgctcaagtagttatctcacaggagcgaatccatttctatgagcccaagtggagtacaccttcagaatgggcgcttgaaaacttataataaactttcaaaaaggggcttgacaaggcctctttttcatgctatagtaagactatagaaaagacttaggaggacattatggaagacttatttaaatttgcgtgtacgcttgtgttaatgactgttctaatctctgggtatgtggctattcaattagttattatagcagtagcaggaacctttttaccgacatgggcgtttgtaattgttttaggatggcttgtatacactaattacagagtattgttgaaaggtggggaatactagtgaacacggtttaccaagacactcaagacatttatttgaaagctttttggatttgcattgatagagctagaaatagagcaggcgtaacatggacttaccttcagggcggcgatacgcctagagcaattaatgggacagctaatccatctatcaaaaaagactttgcagcttatggacaagcttgacttagatattgtagactttcaattggacgttgcagaaacttacgaaagacttttagaaggaggactttattaatgaatattttaaatggttcagaaatgtctcggttaatttacatggtggagtgtcagttagctgatgtaaaatgtaacttggcgttttatcagcaggattccataagtggtagcccaggaattatcgaatcccttacagaagatttaacagagcttactagaattaaagctcgtttagaagtaatgttagagcaatttgagaaacttgtttaggaggatatttaaatggatttaacagcagaagaattaacatttttagcttgccttgttgaaaacaataatgaagaagtgcaggattcaataaacatttacaaatcctttgataaagacgctgcagccaaggttcttgaaaagcagttgttagaaagtattagactggctagtaggcttcgggaagagtctaaaaaaagtatgcttatcggagggctttccatatgctgattaaaaaggaaaagaaagcctacctattcaccatttatggattgcattcctacccctctgtgataggtgttgactcttattcagattcagtagctatggaacgcttttataagatttggcggaaacactatccaaagcattacaaaacgcataaagaatttactgttaaaaagtttgatatttagtattgacaaatccaccaaggggtgttaagatagatttatcaaatgttagggagggctttaaaatgattccagaaggcacctatttaaaagattcgtcaggcctcaaccattactttatcgaaggccacatcgtaggcgttaggacaggagtaagaggctatcagacagttgtttgggataaggaattggacaaaaatgtatgaacaaaaactttcacgaacagtctctcatgaacgatgttaaaatgtctaagaaagaaattgaagagtttaacaaaaagtattatgaatggagttggtcacaagatgtctaaacatttctatgcaaacactagcccagacatggctgtaaactatccaaaagga

SEQ ID NO: 2 - DNA, 139885 bp, Unknown
  Description of Unknown: Undetermined Bacteriophage F170/08 polynucleotide
tttgcatattgctgtaattcatctggtgttagctcttctagtctttttttcatttgttttctccttctaatgtaattttctctacgtcatcaacactaccaaaagatgggggttgtgtcaagttcttatttaaccagttagcgataatgtcatgtaactcgtctatagcctcatcgcttacttcatccgttgggtagtagtcctccgctacttctccatattcactgtatagctgttcccctacagattctaacatacctactacatctacactaataactgctttattgaactgccctactgcaaagcttgttgcccccttttcaggtaatgccccaaatatatcctctacgtgcatccctaagctatctacatatgtttttccttcattaatggacaataatgcaagttttcctgcagacactgcctcttctctcgtagggaacgtctcacacgctttccatacacctgtgtcttcctctagtgctaatgcatagtctttatcttccattgtcttgccctccctatccttttagtataatcatatttgtgttactgtctaagtgccatccatcaaattctaaatagtggtcataggggttaattggttcacctacaactatatagtcctctagtgcgtgaccttggtcttttagctctagtaattcgtctagtaaatcttgtgctgtcaaattattcatgccatgtagtatcctttctttttagcttcttcccactcatctacataaaacaaatgctctctccgagacagagagccataacagtttactgttaagtctaccatcaaaaagcccttatcatgttttgtccaatcctccgtatagggtgtcactgagtgtacttctttaatatactgttttaacacattcattttacatgcccctttcttggtttgaattttcgtgtttgtgttcggttgtttctactcacttctttgtatctacggattcctaatgccttagattctggacgagaacgacctatctgtcttacatataagtctagcgcttctcttactttatcatcatacatcttccctaattctcggaaatactcaaactcacctaaatccacataaggcatacgccagtcatctagggtagcctttactattgttcgtttgtttaaatcataattatagatatatagaaacactatataagcacctgtcatcacagaatagcttgttctaatttcacgtagagttacgctgtctcttaatgatgttaaataaccattccacttttttttacgttcttctgctaaagtttctatgaagtagtttacctctttttcgtccctcactacttgctacctccttgttgtttatgtctatatattatcatctactttgttatatgtcaacacctttgtaataaaaaaagaacctagtaatttacttacttaggctctcttgtttatatgtgtttagcaagctacctttactatcgacaacaacagcattaagctgaccaccatatgcacaggcaccatcaatgaaaatacttctatcacctaagaagacatcgtaactgttctcttttctcagattaattgtgggtgtgtgacccattacaattgtcttatctgttttattcttctgtaacgctagcggtctcgtccaaatcatttcatctttagtagctgttttccaatcaggctgacgataaacaggtatccctgcgtgtacacataaggtgtctccatgctcatagtatggttctaataaactaattacttcaactacatttgttttttctaataacatctttctagtggtaaacgcatcctgtaggtgttcatctaaatccaatagactacttattgttttatcaccgccattgtacatccacattgcgtacatctcacttaggtcttcgtagtctgcttctcttatcaatggaaatgttaaaaaatctaataacatttggtcatgatttcctaacaaagcagttcctccattaagtatatgcttataaacgaaacccagtacttctgcggatttgctacctctatctacgtagtcacctaaaagtattaagtcctcttcatcactattccaatgtttattaagaagcattattagctcatcataacaaccatgtacatctgatacaataaacactttatctttcaatgaataatagcccccttaactacttctgctagccagtaagtagccagtactagtacagtattgacaataaatgttattactataaccagtgctaacttataatttttactcctagcattatagtttatataattttttatgttaactctaatatttttaaacaaagtgctcccatatacgttcagtgctatatatagtaaaagcaatacgataaagtagccttgagctagaaacacgtcagactccctgaacgagttattaaaccatatgctgaatatcgcaatcacttggtgaattataagcattgcgccattaccaaaaaggagtatactaaacgctataccgactacgtctctgtactctgaaagtagtctatcatatactattatccctttagtaaaaataaaagcaacaactgccatctgtataagtaaaaatattgttacggctaataagttttctgtatgcatagtcataatttagccactcctttcaaaatgggtaaagaaagaataataggtatatcgttctttttctaccctaccctcatgtataaaggtgaactcaacaaatttaactcttaacggtatatctggtgctttctcccaaggaagtactcttgggaaatcatagaatactcttgtgggataaacttctttcataagtatcctagggtatcttttctttggtataaatcttttacctattatacttgagtagtcaggtttcattgtaagtcaccatgaatagagtatgctctacttgctttgttaaagtttacttgttttttgtttactaatcttattgcatcttctaataaaagaggttttcctaatttatggttatctaattctggtgagtctacccctacattcagtaagtttggttcgggtctggctaactcatgaatgtgtccatgtagattaattaggttacctctatctcctaaaattagtgggtaatgtgtcatatgcacaaccttatgcattcgttttaaaataataccaacgtcttcccaatgaaccctatcattcagggaagtattgcgtttaatctcttttcgtagaggactattatcgtggttaccctttattagccatatagtgccatttaagcgctctaagacgttagctatactatttaccttggcacccattgcgaagtcccctaggtggtatacaacgtcttctggacgtactgtagtgttccactcattgattagatactcgttcatctcttccacatctttaaattgtttccgtgtgtccataaaagaggcttccccacaaatgtttctatggaagaagtgcatatcagatattacatattctctccccatacttgctcctccttagtgtgttgcaaaccatacgaatacagctagttgtagatagtgtactgtttggtcgataattagttgtgtctttttattaggtactgtttttaagaaccatgcactttgtgcttttaaatagtccatgataaaatgtggaacccataagcatactacaattagcccaagttttactggtgttcctaagaacaatgtagttgcgacaataatatacgtccagatgtttacatggatgattagtagatataaatcagtctgctttccttttgcgatatagtcactttgtaaggcatagtcccctactgcatgagccattgtaaggataattacatagtataagtaattcaaattaagtcctcctctttgtatgggtaaggacaagtgtcacattcaaatccatattcgttaggtgctccctctaaaatatttccgccacattctgggcaagttactagtttcattgttctgcctcctttacatgatttcaagatatagccctgcacttgatgttgtagaaatcagcataacttctaagtctaagtgttctccgataccttcgtattgttcaataagtggttttgtttctgataaagtgaatgttacaatttcttaatccgtcatgtgctctactaatgtgactgtgcgaccaaattcaatatgttgtaataaatgtcctagtttaaccattataacttccctccatcaattaataatagtaagataccgcctatcacaagtaaccagaatactgctaagattagtaccatttagctatcctccttgaacagctcatcgtataattcttgaactgcttcacgctttacttttaacattgcaatctgtgttgatatgatattacttggttttcccaccaaacgcccctctaagtgtccaatatccatattatattgaataagggtttgttgaaatttttttctaatctcggtgcattcattaattggctgcttcggttcaatctcaatcagttcaaactgagaataccagtattcatttaatttattcagtagctcaccacgtgtttttccagattctgcagttgtcccatcatcatctttaataaagtaccctatagtattgttgtgagcaatcctatactctttgccttctgtgaaaaagggttcttgtgggtttgtaattacacatttcattctgtatgtcattttagtaggtctcccattcctcaatgatgtattggcttttatagtttgcatagaaatctgagtcacttgagaagtatatatctagttcttttactttttctagtactccttgaagggatgtaccaactgccatgttagtacctgtccccttatcaattccgagatagagtgtaagtttctttggttctgcaccgagcaattcaaacttagaatgccaatagttatttaattcagctaatagtagctcaggagtggctcctgattctataatgtctccctcatcatctctaaggaagtaacctctagcatcatcatagaatacatcgtactctttaccttctgtgaatatatgctctgttttaagtgtacatctaatttttactgtcattctaattttcctccaattcaatttcttttattgatacaaagccaagtatattgcggaaagtacggtcttcattccagtatataaattgtgttagaagtggtttgtggtcatctgtgtatgttgtttttgtctcgtagtagctttcttcaatttgttcatcaatattctgtaccatttcattataatatgtgactgctttatcatatgaggtgaaagccctcatttttaccgctctatactcaaatttcactaaccatgctgagcttaatttcgtcatttatttcttcctccacttctttgattgacttgattatatatctgtgattctctctaaatgcgtggtaagcatcatcaagtgaatatgcgtataaccttgttgtttgcattacagttctatatccgttacgtccaaccattggttcgtcaacttctacttctaactcaaataatagttgttttctaatcattgtttttcctccccttttctatgatataatattaccctactattatgattctgtcaacaggcaaaaaaaagaagtagaaaaatctactcctattcatcgtttgacaacttttccataccatatagtaactgtagtagtacatatagtacaatatcaaatccgtcaagtggctttccaagtactataactttaacaattgtcaataccgctaaaaaaataaatagccacccgattattttatttgcatgttttctaattctcataactttctagtacctcttcaatattctttctggtttcgttagctaacttaccagtccgttcaagccaacctttaaccatttctttttctactttgctatgtttattcgcatcctccttgatgccttctacattttccatcaaattatctaagtcctccataacatctaataaagtgtttcttagttttaacacatcgatagacaactcatagttccgtttagacaatttttcgttacggataaagttcttttttagttcttgttgtgtttctagtagctgagtagttttaataatatcagcttctaatttactaattccgtctagttcattcatcacatgtcctcctcatattctactacttcctcaataagtttcagtacttcttctgctgtgcccactgtgctatagtccgcaaagttttctgcaggtttcataatagccactgaatagggtttgttctctacataaatatgcccgaatccttttaaagaatgaattacctctactgcccatccattagcgtactcttctcggtatactacttgctcactggttgctcttactggtttattcattgttaaaaccatagaagtttcttacaatgttttctacacgttccatgccctctaagtagctacgtttctcaggggagatatagttcttgtaatgagggacttccttctcttcctctacctcttttgtagtacgttcaatcagtttaataagttttacttcgttctctagttgagactggataatgtctaacagttcatttttcgagcagttgtttagtggtttacttccatagtcaataattgtcatagtagtcctcctattttaatgtgtactctttatagcctttatgtgtatcgtgcccacactttgtacaaaagcctgcttgttcaatatctattgaagagtaacctgtttgtactgcatatgtctcataagtatggtcacacgtatcttcttctgattcgtctattttctctaaacgaatagcctctccttctgccacttcgtggttaaagagcaatactgcagttttaataggttcatatatatctgggtggatggcttcattcatcttaaagctatttccgctaaattcattgaaagcgtctagccattcctgactgttctcatatgatacaattctgtaattcatacgaaagctcctctcgtgttttcttaaataaccaataccgttcatcaatttcttttatctctgcctctgttaaatagtagtcttttaatttagatagggtatcttgactcaatggctcgtttctaggcagtatacttactgctaacttcccgtccttgcgtaatagtaacccgtagtctctcttctgtttctcaggcattactacatagtacttaggtaaactagcagtgtttgccactgcttgaataaaagtatctgtatttgcgaaaaaccatttactaaactctgacttagggtactcacatgagtatctctgtccctccaagataatttgtaacttatccataagctgttctcgttgtttatcaataaactcttttacctgttttggcacttctacctcgttattcataacctacctcctttgttatactttgtcaatagtgatataaacatatttaccttctaactgcctaacaatgtttagtatgtcatgaccgcctagcttaaatgtgtttgtctcaaacccttcgatagtaaaggaagaccaaccgtaccaaccttcttcaaagtccaagacccccatagatttaagtactatatttttagtgatgtcttctaatgaagtacgttctacagcagagaaaatctgaatctctgcgttatcaagatgatacttagaagaaatgcctccatcgtactcctcttctgttgtagtgtcctcagcccctaacgcatgtagtgcattacaaataagcatgtttaaggctctgtgctcatggtgatactcaatttcttttactttttcttttattaagtaaggttcgtttgtttctgcaccggggctgttatcaatagttacccaaccttttaatatctgtttacccatgattgctcatcctttctttagtatagcctatcgctgtcaccagtaaatctaaattttcctttgtcagagttactgtttgctcatgtacacagtccggtctaaatacctctactgtacgatttattacagcaatatctacagtagcttccgttgtctggcttaccttgataaactgtttggaaaactccccacggctaacaccttctatcataagctccatttgtttatagcctcctctcgggaaagtccatgaaagttgtggaaagtacgctcttgtagttcatctaccgtatctggtagtgtacgaaattcgtctacccctagtgaaatacttgaagctacctcttcataataacatttaacgtctactcccatttcaccataaggtaacaccattacttctatatgaaactcatatggagtattctgtgttaatggttcatctaataaccatgtctcatggtagtttactggaatatctaatagtaaactgtttaaatcatctagctgttcagataagtatgcaattcttgtcactttacggtcttctgctataggcattgaacaacctaacgtgtcttttatttctttaatttctttggtaagctcagccattaattcaattattttataaaacatctctattcctcctcttctatatattccccttcttctaagaaaaagcaagcaggttctccctctccattttcagtgtcacctaggtactcatcatctaagaatgcacagtatccagttgagtagagggttacacagtccttatgatacatcgaatcgtccgttaaccgcacaacctcgtccatctcactgaacacttcattacacgccccgcatgatattaactccttactcataggctacctcctttatctattacgtagtctaccagttctctaataacctctgcctcctctacactagagaggtctgcccaaacttgaagtgtcgcatcgttagccttaccagatattaaattgtgtaagctatctgcaatagttagctttgtacgttcaagatagtggattagccagactaatacaattagctgtttctcagttagctcagtagtagtctctgtataaacctcatagttatctaagattaatgggagggtgtcttcattattaattacttgaaacccattatttggttctcgttcatactctccataggtcagtctcttacctatttttagttttacatagatgtctctaccttctttgtgtagtttgtctaggtcactattgtaccactctcttgtttcaattttagtaagtcccatagactagccctccttgcttagctccttaattcgtttcttgatatttgcttctgtcttctcaagttgtctcattttgttagcatgacgagacatctcatgctcttttgcagtcactgccatcgctaataggttctctaaacttactttatttgccattaaattgccacctcatagttaaattttccattgtgtttataatttactacagaaatatctgataatggggaatcaaagaagttcgtccccttcttccatggtaggacaagctttggaacctcttctggaattggtgcgtttacctgtttctctactagctctaaatgtcgttcgtaaatgtgtgcgttatcactcgtccaatataagttacctaactctaaccctacagtatttgccataaccaattgtaatgcatgatactgaataatattaaatggaagtcctaagcaaacatccgaagaccgagccttcacatgtaagtttaatttaccctctacaactgtccagtgggttgtccatacacatggttctaatgacatatcgtataaatcttccacgttccataaagtagtcataattctacgagagtttggtgtgctcttaagttgttcaataactgcctctacctgatttagctttaggtatggttgatgtgttcctgctatccaaccaccttttttaggtacgacttttggaataagtgaacctgctttgcgatttttagctaactcaacatctccactataaacaggaataaaacgttctttgttaaataatgcgtaaccatacgcttttccaatagtgccatcttcttgctcccattcgtcccaaatagttacacctcgttcttttaaccacgaaacctcattagacatttcttgccaaatccactgcaattccgttagcgcccatttaatacctacatgcttactacgtaataaaggagcccccatatctggtgtgattgtaaagtttacaccttcaataaacttagttgttgcaggagtcccatcagcatatactgcacgagtcccttctggtaattctgttactccgttcttaataatatccattactaaatctttataaattttatcaaaatccatgttgtgccctcctacatttcttttccctataatagaaatatatcatatataaatttaaaagtcaacaaaatattataaaaaatatgagacataccagtatgtcccatatctactaaattctatactaaactggctagcttgtctaaagcgttatagtccgcatcggttactggttctactttacctaataagtacccattacctacctgagagaagaagtcatggttactagttgttgtagagataccattcattacaatagggtttacgtctgcacttgttgttgggaataacgggttcatccctaagttagctagagctttatttaaattgtactccaaaaatgtattaacatcttttgtccaaccaatctcactatacagttcagcagtatactgtgtttcgttctcccataatttaaatgctaaatcaattacccattgttccatttctttttgttcagtttctggtaactggttaaaccctaactggtatttatagccgatataggttccatgtacagactcgtcacgaataattaatttaataatttcggctgtattaaccatttttgcctcacctaaatagcgtagtggtgtgtaaaaacctgagtaaaataggaagctctccaacagtacggatgcactctttttctgtagtggtgtaccgtttcgataaatatcgttaataatattagctttatattgtaaacgtttatttgtagctacccattcaaagatattgtcaatctctgtaggtgtattaaatgtgctaaaaattgttgaataacttttagcgtgtactgcttccataaaggctatgttatttaaaacagcttcttcatgttgtgttcttacatcatcaagtagtgagtgtactcccgattctgattgaactgtgtctaataatgttaacccaccaaacactttatttattaaatcttgctccatatcagagagctttgcccaatcattaacatcgttacctacagggacacgtgtgtccaaccaaaattgctcagtaagctttttccatgtggcttggtcaattacatcatcaatcttattccagttaattccttcatacttttcttgcaaattcatgtgttcatctccttaaattgtacaactttcacactctgaaacccctacttcgcttccgtcttcttcggtgaatgttctaacataataaattgtttttataccttttttccatgcataatgtcttaataaagttaagtcccgagtggatgtagcgccaccctccaccttccaaggataaagattttctggtaactctgagcgcataaacaatgttaaactcataccttggtcaatatgtttttgtgccgttgcgtacacgttgattacgtcaatcatacttgtgttgtacgctgacttgtaatatggaattgtcttctcagataaccggggtgcagggtaataagttttacctgttttcccatcttgacgttcttcaatcatagagataattgggtgcaatgaagaagtagtctcattaacataagcaatactaccatttggagccacggctaagcggttttgatggtatagaccaccttcaataatactgtttcttaatgtttcccaatcttttacattaggtagcaccactccatcgaatacttccgccaccttactagagatttcctgatttagtgttggtacatattcatcaaagtaagaaccgtctgcgtatttagagttctcaaagttatagaatgttgtgccacgctctttagtaatcttattacttgccaccaaagtagcatagttaattaattcaaatagggcatccgtcatttcaatagattcaggtgagccgtattctacttggttacttgcgaaccacgcatgtagtcccattgcccctaaaccaattgtatgggctttatcattaccattcttgatagtaggtactgcttttatatttgacacatctgtaatatatgttagagctcttaccatcgtctcaattgatgccactacatcattagatgtttctaacaagttaaggatgttaattgaacctaaattacagctaatgtctgtacctaactcttcgtatacttgttcatcatttagcttagatggtgtctgcacttgaaggatttctgaacatagattgctcataatgattttgccatcaatagggttggctttatttacagtactaacattcataatatatgggtaacctgactcttgttgtaaacggctaatttcttcttccaaatctcgtgcattcattaccttacttctgatatttgggttctgaatcatgttattgtattctgaatcaatgtctacaaatgagaatggtacaccgtattctttagcaacatcatatggagaaaataagtgaattacatccccagactcagctagctcataaaatttatcgggaacaactactcccaaagaaagtgttttgatttgctttgcggattctgcattttcttttctagttgataaaaagtccataatatccgcatggaaaacatttagatagactgcgcctgcaccttgtctttgtcctaactgatttgcgtaccggaaaccatcttctagcattttcataacagggacaaccccgctacctgctccctcaattcccttaatagggtctccaagagctcttaaattacttaggttaataccaactccaccaccaagtttagatagttgaagtgcactgttcaacgttctaccaattgaagacattgaatcttctacttgaattagaaaacagctgacatactcccctcttctaagcctacctgcatttaaaaaagtaggggttgcaggttggtatctacggttaattagctcatctgcaatcttcatagcaagctcttcgtcaccatcacccattgtgagtgcattaaacgctactctatcttcataacgctctaggtatcgttccccatcatctgttttcattgcgtattgtttgtagaaacggtaagcccccataaatgtgtcgaatctgaactttttactatagatgaacttaaataatttttttataaattccattgagtacttgtcagtaatcactgttttatcgatgtacccttctctaataaggtaactaattttctcctctaaagagtagaaaaatactgtgttcttgtttacatgttctaaaaagaatgctctaacagcttctttatctttgtctaactgaatctttccgttattagggatattcaattggttattaagctcaatatatgtgttcatatctacaccccaagttctttttctagttttttaaccaaatcaggtctaacaccattaaatgagaaaccatcatcagcttctacatatggtaatgaagacactcctttttcttttagataagctaaagcttgctcatcatgagagatatttttctcatcaaatgggatattctttccatttaacatattttttaaaaataaacattgaccacacatatcttttgaatatactgttacttttgtcatttactacattctcctaacttttttatcgtatttattaattatacactattttgcattaattgtcaaaaataaagaaccaaaaaaaactagagactacaaaagttaattgtagccccttttaataagttacaccttgtcacctaagaaatcttctgattcctgcgatttattcgtaaccttatcaagtagtaaaacagaatagtttttaccagtttcaacctgcaacctattaaacactttctgatattcttctggtgtgtctgtaacttctaataagtattttgcatttaaaaatgatagtaattcaagtagttctgccttactacctgccatttgaactacaacgttaccttcatcgttcgtgtatgttccaattttatttctagtagccaaacaaatcagtccttcgtaaatttaatgtatttgttaactgtatacacatttttaactttttcccaaacgttagggtatacgttcatcaataacttagtatctgcgctagcacgtttgtactctggcattaatttaaatgtgcccccatcaatactaattttagattcccctaactcttccatatcagaaatgatactactttttagctcatcaatctcttctttaatacttttttgcaattcatataatttcttgtaagagcgtaagtccttctctagtagctcctttttttgtaaatctgttgttttcatacatatctctccctctcttatttctataataagattatagcatgtcagatatgtaaagtcaacacttttttatacaaaaagaattgcccattataaaggcaattcttgtccgttgtcttcttcaaaaagaatctctacaggtatattatataatttagcaagttttactctgtttttaacacgaggttcttttataccgttttcccaataagagattgatgaccagtgaactcctatcatattggctaactctcgtagagattcacccctagcctctctcactcttttaaggactttaggttttggtaccttttcttccatgactatccctccttattcttaaaaaataagagcctatcaggtagacaggctcagcatcaggaactatgcgaaagccccgatataagttactttaccattacatttacgtgcaaaagcctctaactctttacgagcacctaaacggtcaggttgcgaagattgaacagtaatttctttaggtaccgttacttcacgtgtacgaatttcagttttaccattttttaatttcttctcatactcctctgtacgagttgttgtcgtagaaatgattccataaaattttttcatattaatagctccttactgttttttttaataaattataatagtggtaatagggttttatgagactcctactcattgtaagccttccttaatagatacttacaactatacgtttatagacctctctcaaaaagtctccgtaacgtcttaccttcatcatttaaaacgtacacagaatttacaaaagttttatacccttctttttcagttctgtactcgtaaggtgaatttggcacacgagtgatttcttcatgtttagagttaagtaatgaaaaagcattctcttgctctaaaagaaactgtaccccatcaattaattcaataaaaggcttaacaataggttcctctgtactgtctttacaatcgtattttcgttctcctaaaatttgtagtatcatgtctatctatctcctctgtttaagtattaatttgtgagtttccactcacaatgctgattgagagagtcgaactcccattcccgggttacaaaaccggagtaatagccattatactaaatcagcgtaacccctcaatagagggagtttcttatactaaattaccatatccgtaggtatttgttttagcttgtttaaacatgatactcttgatagctaagtcattgtacttttcatcgtcttcgtcatcaaggtacacatcaacattaacgttcttacctaaaatatcgattgtttcatctttacctacttgtaagtctttactgttaaatgatacatcaaaatagatgtcgtcttcttttgtacgactaccgaatgatactctatcttcaaataaatttaaacttcgagagttaattacaacaggttgtagcccaccttcaaattgaatagtaactgtataatactgattttcaatattaagaatgttcaaatcagcaatagcttcaccaaatgagatgccaaagcttaattccaacgcaattgctcgtaagcaatcatagtttaacttaattctacggctaaacttaacaacactgtcaatttccccatagtaagctttgtctaacttatcttgcaagtaagtacgaatttcgtctgcatcagggtagtcgaaacgtaaatgataatggaaacgtcccggacgattaagcataaagtcgtttacacgatttaagttattaacagtaagtgcataaatacgcttgcgttgtgataacccatcgaataagctcaatagtttttcttgtgattcacgaccgtcacggtcattgaatactttttcaaattcatcgaacaagataagagactcttggtcaatactgtcaataaattctgcgatacccggataagcttctgtaattaagataacaggcataccctcttcaatagctcgttgagataagatttgagtaaatagtgatttaccaatccctttatccccacttaaaataacccctaaactacgattgattgttttaaatgtgtgtagtactttctcaattttaactaaacggtcaccataaactttagattctttcaatttaaaatcgtctgtaaccgccaatgagaacccagacattgggttgaatctaactttataagtttgcgcaggcaacttatcataagttttcaggtcgtttgcataaatctcataattactaccataattgattactttcatatattctctccttaatactttttaataaattataaatggagagtgatggagtcgcaccacccgagcctaagcaacagatttacagtctgctccgctactacttacggaataactctccttgaataaccaaccagataggtacctgacacacggacagcacctgtgtctctctgttactggatgattaattgtgtatttcgcatcacctaatatagttatcaaggtaggacttgactatactagatttagctaggttctaactataatttcctatgatagctcctactactaatcatatttatatacagttaaactacacataactaaaccgattaccttggttcgcatgttaagaggcgcaggcaaccaatggacattgcaggtctcgaacctgcgaccgttcggttatgagccgaatgctctgaccaactgagctaaacgtccgtagggtagtagcaacaattacaaatgctactctcctgatgattataaacttatcaaatcggaaagacaggacttgaacctgcgacatcagactcccaaagcctgcactctaccaagctgagctactttccgggttacctgtttaatttggtcttttaaactactacacacaggtaaagataaaccctctgcaaaggggagactatcatcgaaccgtatgtaagttgcgatgggtagtagccatattatattaggttattaggaagttcacctatgcagaaggtgggagtcgaacccacacgtccattacagaccgatgtttctaagacaccgttgtctaccagttccatcacttctgcggttgtactaccaaggttacctctaaaaggctaaactcgtgtctggtagggagccataccttacatggattgcaaggaacctaacctcagtagtaccttttactattaagggtttctgatttaacgttttccctagaccgtaccttaacagtaatactggtgagaggatttgaacccctcttacctacgagcctccgacaagcgctatgggagacaagcggtgcattaaccataactatgctaaccagtacactactgttttacgcaatccgcatattagtagttcgcacggactcaaccctattaagggaagtggcagtctgattttttggtgggaactatctaactacttagaacattagatattcccagactgctcacttacattgttatttaatgtcacatgccttatgacagccgtactcaaaagtttcaaggacttttacctcactatccaccgacagtatgctcggcaacgtctttctaataatacttgttaaacttagggaggtataacaagtatgtgcacataacccgagtgctactccctaaagtagcctatacgggttaacgtagatggagggaatcgaacccccaaccgtccgcttagaaggcggatgctctatccgattgagctacacctacaaattatgggggtaatgagcccccataataactcatagtagtttcatctatcgaggattaaaatgaatatctaacttgaataaagtataacactatttacatagcatgtcaacacttttattaaaataaatttctatacctcactaatgccaatgactatacgtaaggagagaacgttgatggcactggctacttagttggcgctaagttagtgaggtatagaaagagaactacattgaccgaatcgtattatacagccttagtagttgttaacaatgtttggaacttagtagcttattgcaataagctaccccgaagcatcggggtgggactgtggtaagccccaaacccttgggtatgctccatcctgcctccggagaagtcaggctcaattctcattagttaaaggcttactagttaacggttagctgattagtcatactacgtaaactactagtaaaatatagttttccaattaaggctaacaatcggtagaggatttgaacccctattattggttttggagaccaacgtgttaccagttacactaaccgactatgtaaagaaggaaagcgaagaccttctttacagtaattaaaaaaacaaacaaaaaaaaatacaatcatggaatcaaggtgggatgtaaggagatgccatgtgtccacttatagtggaataggtaactacagatttgcactgttttacatcttgtttaatggttacctgttaatagctaacttccagtgataagtcctcttatatgttagttcatgtagtatttgtttgacaatatggtagctatctaaaatgacgacagtaacgggactcgaacccgtgtgttccacgctgacaacgtgttgggacaacctctgccctatactgccattatttatgccgtagttttttttagaaaggaaagttttttataatatacaacaacagttgaagcgctgatgttactacggcataaacatatttttatgagcttttaataactcaaaacttaatataatagggcttttactcctgcttcatgcacactcactgcattcggtcacatacccagagaggctgaactatcgggagctacctaatagcttctctctgcttttaatgtatggtctagcacggtggctaacaacgttcacctaaacattcagcattcaatagtattgttataagttcttcttatatcatatattttgtaagctgacttaggctacttgtaccaaggtctcttgttaaacccatatttctatggttctcgtcaaagggagtctttttaggtttctaaggtctgccaagtttctcacgcttccacctaacttagattcttttccacaggaacgtctattatatcccccaagagtcttgtaccttacaatccatgtacactccacataacgcttaactgatactagcttttactagtagttactcttatgtcaccataagacatacctgctacctaaaacactatcgcactctaggctacattcagaattacgccacgttatcctagcaagctgttcaaactttctgcactaggttctattatattaagttttcaattatcaaaagcagtttttctttactatttaataatagcacaacctctattattttgtcaactacttttttttagagagggtgcccctaattttatataggggcaagagatattaaacatagctgagctatgtaaaagctaatgtaggaattgaacctacttaatgtaagcaacaccagtttagcttataagcattgtttgcaaagtccatgctatgcactcagtaggaatcgaacctattgccgaaggtaccaaactaccctgagtgctcctatagatatattataccacataacgagatattaattttttttggtgatatagtatatctatatttttttaaattttagaaatacctttgatacattccggttatccaacgtatgagtatataatatcatgttattctgattgtgtcaataacttttttacattttttttataattgtgtaatgtcctatttctttttttctgattccttatatttattatttatactatatagtactatatatattagttactattagatattatatatatagataataagactctaggaaatttaaaataggacattctaatgctgactcagttacaatcaacttatggtggctaccttttacaaaaatgtcctatttcattttttctctctccttatattattatttataatatatagtattaagtattatatattattatatatatatagtatataatataagaaagacaaaaatttaaaataggacattttacttaaacaaaaaaaaagagagcagttaagccctcttatcttaatgagaaatagttattaattgttcccaacctgatttcctcatcttctggtgtttcatcctctggtttcgtatacaagctagtgattctttctggaacatctactacgttctcagtagctgtctgtatctggaatgcatttacataagttaactcagaatctctatcagctagtttatgaactggaatcattggcaactctgcacctttcattgcaccatttacaattgacattgcatcattagttgttacaccgagtcttctagggaacacagaatatgtcccagatgttaatgaaacctctacaactttctctcttttagggtaattcatgatacttctcctttcaaaatatgttataataatactatataccataataacacattttacaaattacttaaacatgctgaacacgtaagtgacaactgctcctaagacaatcataaaaacgttctctacaatatccctcttgtggtcgaactctttatcgtttactccttccagtgcatctatagtttcttccaacttagtaatctggtaggttaggtgtgcatatttttcttcgtgaacagcaagtcgcttatcaagactattgacaatatctctcaactcactaaccgcactattcagttctacattgtcctgtttaatgcccttctcggttagctctccatgttggagtttatcttccagtcgttgtagtcttaaaacaaggtcatttacttggtaatcgttcatatatgctcctccctgtaagttatgttgctctatattagtcagatgtaaaccacagacagactaatatacctataatagcgcctaccgtgtagactataggtatatagtacccattaaaaaacaagtatagactacctatactaattccatagagcacgaaagtgaacttgtatgatgccaaagggctcagttctgcttgtagtttcttatactgtagtgcacgagtgacatagtaggacatcaagtaaacaaacatttgcagtaacagtacacagaccagtgctgtttcatacattatgttgttccctcctctcccttagagctactattaatatagtacactgagctgttagcaaacaggtgtgctaaattaatatagagactaaaaatgtagacgggagagtggtaaaaatggataatagcaaacgaattattaaaaaaattatttttattaccatctctgcattagtcatggttactttaagtaagctgttctctaaatatgttattgtagaacaaaatgccccatttcaggcattaattggcggtgcctcatgtgcattgctatctagtattctgtttgattggtatactaataaaaagaaaaaagagaacgtagagaatcaacttaaagaagcaatcagtgacttgcagaagattaaagctatcataaaaagatagcctattaggaggtgggatgggtgtctattaccaataaagacattaaggataaacgtagatatatttttagtcaatctagtaaaacaacaactataaaaagaggggacaaacgcataagtagtgcaacaagaatatgtgcagtttgtggaagaccgctgtctaagctcgtattaagaacaggcgtaccaacagtagtagtagaccatattagctgtaagatttcagacattgttagactaaatgtctgtgaggatataaggtcttgttatgcgtattctagtaagaaaggggaaagctagctaatgggtatggcagatagacttaaagataatgcaaaacaaaaaaagttagaaagaacaccagagcaacaactaagagacacatttaatcaagcttcaataaagcttatcaatcaatttatggctaacgttacatcaggtgctatagaagttgatgatattgcagatttaacaaggctatttcagatttatttacaggttaataatataaatgatggaatgcaagaaggtacaggaactctacctgcacttacatctgagcataaagacatcatatctgaaaaggttagcacagaaaagattattaaggacggtgaagaagaggagctaatttctcttgatgagttagccagtcttccagatgaccaacttgaggaagtcttagttaacagagagctacagatgaacagagagaacgaggcgaccttctaatgacgacaaaagcacaacatatagctaaaatggctaaagagatgtatggtacggataaaattacaacggagcagttagcttatataacagatatgctgaccccatcaacgtacctattgagaaatcactctgtgcgtaatcacccaataacttttattatatcaggaagggatgcaacaaaagcacaggcacaccgaccttggcaaccaaagataataaatgaccaacatagagacaaggcaataattaaatcaagacagctagggctatcagagatgggtgttggttctatgctacagtttgcagacacacatagttatgatgctgttaaatgtctttatacatttccaacgaatgaacaaatgactaaatttgtacagacaaggttagaccctgttttacagaatgggtactacagcacaattgtagaccaagaagttaactcattaaaagctaaaaaaataagaaatagttttttgtattttcgttcaagctcaaaaccgggcgctgtagagggtgtcgatattgactatctatctatggacgagtatgaccgtgtacctgcattagcagaggcttctgcgttggagtctatgtcttcatcaccttataagatagttaacagatggagcaccccaagtgccccagatatggggatacatgggctctttaaagggtcagaccaacattggtatttacataaatgtgagaaatgtaattattataacgaaatgagttatgatgcatatacaccagaggctcctgtagagagtagaggtaacattctttgtgttaacccaaaaggggtcgatgttgttgctaaaacagtagttgacggctcattccagtttgtttgtcaaaagtgtggagaaccgttagacagatggtacaacggtgtatgggtacctaaatatcctgatagaacaaaaaatggtctaggtactagaggatatatgatttcccaaatgaacgcagtatgggtaactgccgaccagttaaagaccaaagaacttcaatcattgtctaaacaagccttttataactatactcttggatacccttatgcagacttgaaattaactgttaacgactctgacgttgatagccataaaagaaactatttagtagaacctgctaaagacagaggtgactataaatttatatctgttggtattgactggggtaacagacattgggtatctatacatggtgttaaaacaaatggtacggtagatttgataaaacttttttctgtgggtaagtccaacccgctagaccctaatgcaatagatgtagacatacagtctataaaattacaactagctccttacaatccagatataatcgtagctgacgtaggggactcaggggataaagttgctaaacttatgcaaatttatggaaaagaacgagtttttgggtgtgtctacccatcaacccctaaatctactggtaacctagtacctacttggagcccacaagcaaataaagtatccgctgacaagttaatgcagaataaacgttacattaacaagatgaaagaaggagaaataggttactactcaaaaccagatacagagcttaatttatataaagagcactggaagaatgttgttatacgtgatattgaggacgaaaagacatcgacaggttttagacaaattatcggcagaaaaggtgatgaccactactcacaagcaagcgtttattccatgttagggtatgagtacctaatgaatgtatttacaggagtaaaagagtatggatttgactctgattgggtgtccactcagttagcacctacgaaacctgatatatttacagaatttgtataggtagattgccttatttagttttagtcaagctgaataaggcattttgtattgtttgatatatatttttgtggtataataaatatagttagggggatagttatggtagacaacaatgtaaaaataagtaaaagtacaattgaaggactaataaataagtctttaagttatgagtacgttataaaaaataacgaattgctgacaaacgaatatcaacatattgtaaaagcgtatgggtttgacaatttttatgacatgtatctatatgcagatagctgtgattctaaagatatgtatttagtaaaaggtggtcaaaaagacttgtctaagctaaaacctgttaaaagaaaagttgttagaaatggtaaaactatgactacaactatttatgaagatacaggcagttcggacaataataacagtaaccctttagacaaagagagtaaaaagaaaaaagagttagaaccagttaatgctaaggaactacgtaaggttagcttaggtagtgatgaagaagagaagttagaccctaaaaagatagcaaaattgctagcagacactaaaaaatttggaaataattttgatacgcagtgtactgattatcttattcttgaacaagactctgttacacgaggagtggtagggtttactagagaaggttcttatttaaaaatgtctttctcaatgtcagatgaggctgttgagggtatgaagatgttagctttttcacagctcacattaaaggcttggaaattgggtctaggggctaagataagcacagataatgcacctgatgtagaggaactaattagcttatatggatacaaaagaaataagacagagtatattgtgtcaatgagctcactgcgtagtcttctaggggagccttagtcataagtgctacgttagtcattatactagtattttcaactattatttttttaatttttaatttactagtaagtaaggtagttaaagaattttataacttaaagatgctagcaaaagagggactaacagataaagtaacagatataacaaatgatataatgcatatattgaaaggagaaataaataatatggaattaattatgaataataagaaattagatgaattaactaataaggtggctactgatgaggactacgatatttttgtagagaagatgggtaatctagtcaaagatttgtatgagaactatcagtttttacaacaaaatccaccagaaggagactacacatcaggttattttttagggttccaagtaatcagagcagaatacccagttgagtatgagaatttatttagattagctgtagataaaaatttaaatgaactagagataaataagagatttgtcgaagctgttaaggatggcaaggttttaccattaggtgaggctgtcattgatgaattacaaacagggtgtagctctatactacaggcacaagaagtacgtgtaaatattgtatttggtacaaaagaatacatggctaagcaagaagaagagcgtaaagaacgtcaagctaagttagaagaagaacgggaaagagctatggaagtactaaaaacaaaagatgacgtacttaacacattaagagtaaccgaggctttggctaatgaattaacagacgaagtcgcagaaaaatatgatttaatggagctagttaacagtatgagagaggggctgaaagctcacaatggaaattaaaaattctttggggaaagctcttataaaaaatttaagattgcttaaagaaaaaagagatgcaatgcccgataacttagagtatacaagtcaagttatgattcctgtgccctactatctaataaaaaaaggggataacgcagtagaatcattccttatgtgtgcggggatgataaataggaataaagatttaggtttacctatttctttagagaaaggtaagcaacaagttaagcttaacaatggagaactaacaaccattgtagaatgtgttgctacctactcagataaaactgacattgacggtgtagagagattcttagttgaacatctataaaaattaaattaacgagttctattttgtgctatattagatatgcatgaaatagaacttgtttcttttttatgactaactaaggaggtttaatagatggcaggagaagtatttagtagcttgattacaagtgtaaatcctaacccaatgaacgcaggtagccgtaatggtatcactatcgacaccattatcctacatcacaatgcaacaacaaataaagatgttgctatgaacacatggctattaggtggtggcgcaggtacatctgctcattatgaatgtacaccaacagaaattattggatgtgtcggtgagcagtattcagcattccatgccggaggtacaggtggtatagacgttcctaagattgctaaccctaatcaacgttcaataggtattgaaaatgtaaactcgtcaggagcacctaattggtctgtagaccctagaacaattacaaattgtgctcgtttagtggcagatatttgtacacgttatggtattccgtgtgaccgacaacatgtgttaggacataacgaagtaactgcaacagcatgtcccggaggtatggatgtagacgaagttgtacgtcaagctcaacagttcatggcaggaggctctaacaatgcagttaagccggagccaagtaagcctacaccaagcaaaccaagtaataataaaaataaagaaggagtggcaactatgtattgtttatacgaaagacctattaactcaaaaacaggagtattagagtggaatggtgatgcatggacagttatgttttgtaatggggtaaattgtcgcagagtatctcatccagatgaaatgaaagtaattgaggatatttacagaaaaaataatggaaaagacattccattttacagtcaaaaagaatggaataaaaatgcaccatggtataacagattagagacagtatgcccagtagtaggtattactaaaaaatcttaatactagatttaagaccatcttacggtggtcttttttctttctttgtaatattcgtaataatatgtaatggctatgtaaccgcttgttcttttggctgtaacaattacatgttatattagttcttgtaagcaacacaaataaagaaaatattgaggagaattttattttgaagaaaactagtattttaggtttaagtttattaagtttaggtttagtagtaggtttaggaaccgaagctaaggcagaagaagtaacagagaatgggaagacatattggaaagtagagtcaggagacacactatcagaaattggagctaagtacaacttagacttcactaacattcataaagttaacaaaggtgttgtagctgaccctaatgtcattttcgtaggtgacaaatttttattacctttagatgaaaatggcaagctagtggaacaagtaaataccactgagccagatattgaagtacaatataacgcaccagtaacacctgaacaacctgtagttgtagaacaagaagttgtagagcaacctgtagttgtagcagaaacccctgcccctgtagtagaggcacctgctgatagtagttcagcaaaagagtggattgcacaacgtgaatctagtggttcttatgatgcaacaaatggtcagtatatcggtcgttaccaattatctgcctcttatttaaatggtgactattcacctgccaaccaagaacgagtagccgatgagtatgtagcaggtcgctatggctcatgggagaacgcaaaatctttctggttagcaaatggttggtactaaaattaaatagcaataaagacctctttattaaggggtctttttttatgctatattaatatatagtaaatagtaatataaaatggttatgattagttatgtggtataatagacttatgttaaaaccatttaaggaggggaaacatgggttatattcaagatgagacatggcagatggttaaaaaagttgctaaaaagaatgggtttgttggtgactggattttaattatccactcatactatgagtatggtggaaatcacgtccagatacatacaacaataaacggagaaagctatagaattttaaggttgctagatagcagagagatacttttattagatagaaaaggtaaccctgtaatttatgattacgaaatagttaatgatggtcaaaaaagcttcttttataatgatatggaagagaaagaaatcgaaatacctaatggaagatgcttaaacgataagacaagggtaaaaatttatgtataaggtaggtgtaacagttgccaaaatggttagataaagcactaggtatagaaaaatcgtccatagaagaaactcggaatatggaaaattataagatgcatttaagggaaatagacaccaatgtggtcaataacgagccgtatagcatggaaagtattgaaaaaggtatgaatggcaagaccactgcatatatgcaaccaattattggagagatgtcagtaaaccccgggtataaaactaaaccgtctatacgtaactctcaagacttacataagacacttaaaaagtttggtaataacataatattaaatgctattattaatacacggtcaaaccaagtatcgatgtattgtaagcctgcaagaaactctgaaacaggtgttggttacgagatacgtttaaaagatattgaagcagaacctacttcacatgacattgctaatattaaacgtattgaaagttttttagagaacacagcacaatttagagaccctaatagagataactttacaactttttgtaaaaaacttgttcgggcaacatatatgtatgaccaagtaaactttgaaaaggtatttgataaagatggcaactttatcaaatttgatactgtagacccaactacaattttcttagcaacaaatggtgaaggtaaactaattaaaaatggtgaaaggtttgttcaggttatcgacaacagaattgttgccaaattcaatgagagagaactagcttttgctgttagaaaccctagagcagacatagaagttgggcaatatggttatccagagcttgaaatagcactaaaacaatttattgctcatgaaaatacagaagtatttaatgacagatttttctcacatggaggtactacaagaggtatcttgcatgtaaaaactgggcaacagcagagccaacaagcgttagatatatttagaagagaatggagaagctcactagccggaataaatggttcatggcaaatacctgtagtatctgcagaagatgtgaaatttgttaacatgacaccctctgctaatgatatgcaatttgaaaaatggcttaactacttaattaatgttatatctgctttgtatggaattgaccccgcagagataaacttccctaataatggtggtgcaacaggctctaaaggaggttccctaaatgagggaaactcaaaagagaaaatgcaggcttctcagaataaagggctacaaccccttttaagatttatagaggacaccgttaacacatatattgttgcggaatttggagaaaaataccaattccaatttagaggaggagacctaagtgctcaactagataagcttaaaataattgagcaagaaggtaaagtattcagaacagttaacgagataagacatgataaaggtttagaaccgattaaaggcggagacgttatactaaatggtgttcacatacaagctattgggcaagcgttacaagaagaacagctagaataccaaagaagccaagaccgcttaaacagactattagagctatctggtggagatgtggaacaaccagaaccagaagaacctaaagacaatcaaaatgatacagatgtttcatttcaggatgaacaacaaggtttaaacggtaagtctaagaaagttaatggtaaggtagacgacaatgttggcaaggacggtcagttaaaatcggaagaaaacaccaactcaactaagcatggtactgatggtataaaaaaataataaaagataatggagggggttagctcccccctcaactttgtttgtgttactagatagtacatgttctgctatattaaatacagtaaaacgtttaggtggtgaaaagcaaattgtcagaagttagagaaaaatatagtattttcgtaccactggatattgaaaattctatacagaagtctgaatctgtgaatgatggtgaatggtatgtgcaaggatatgcaactaccccagatttagatttacaaggggatattattttaccacagggcattgatatttcttattttattgaaaatggttggataaactatgagcataaaaatgatgctgagtttattataggtgccccaactagcaattgttatgttgatgtggacaaagggttattcgtagaggctaagctattaaaggataacaagtacgcacagtctatgtggaagctagctaatacaatccagaaatcaggaatatctcgtcagttaggtttttctattgagggtgcagtagttagtagaaatgcacaagataacagaatcatagaaggtgttaaaatacataatgttgcattaacgacacatccggctaacccaagagctacatgggagacactagttaaatcttggactacaggatatggtacagcaccagatgcacaagtagatgcaggcgcacttagaagagagatgtttaaagaggacatttctaatttgacgtatgcagtaagaactattgcagggctatatagtaaaaaacctgcagagaaagaatttattttacgtgaagtagctaaggatatagaagtagacacttccgaaaatgaattatctaaatttatgttacaattaagtagagggatttccttgaaagaagcaacaaactttattgaaagaagaaaggggtaagaaatagtggctaaaacattgaacgatattatagaagattttgatgcacagttaaatgaaaaagtaaaacctactacagatgaggaaattacaaagtctgtagaagaacctactgaaccagaaaaagttgaagaaggtgctgaggttgagcaggaagaaaagcctaatgaatctgaggaaactgcaggcaatgacggagaagaatccggagttactgaaacagttgaagcagaacaggaagagccagaaactgttgaagaagtagtggttgaagagcctgtcgaagaatcagcagaaactgttgaaaaatctgataaaactaaagaaaataaagatgaagaagaggaggaagacgaagaagacgaagacaaaaagaaagaaaaagacaagaaagacaaagataaaaaagacaaagaagataaagaagacatcgagaagtctaccgaagtcgaacaagttatcaaatcttctgaaatcttaggggctatggaagctatctttaaaaatatgttaggtctaagtgaaaagttagacgaaattcatagagagtttaaagaagctaaagaagctaaagaagctaaagaaaaagacgaagctgaatctgttgagaaatctttacttgacaaccctgaaattaaaacaggaaaagaggactcagaaggcaaggctgttggatttgttaataagtctgtagcagttgaggaagaggtagctaccgaagagccaactgtagatgtagttgttgatggtgaacaagacacagcagaacctgaaaaagaagtaccgttccgtgatagagtacaggctattagaccagactttatggaaacatataaacgtgtgtctgttagcggagtagctcaacgtggtgaattagaatcagttagacacacttggggaactgctagaacaaatgaagacctagctaaaattgaagggtttatcaataaatataaataattttactatatagtgaacgatttttaattgtactgctatattaatagcagaaacaataaaagacctgacattccctcctgaacctccacagggtcaggtcttatattgagaggaatataaagaaaggtgatttatacataatgacagagaaaaagaatacagaacgacaattaacttccgtacaggaagaagtaattaaaggcttcactacaggatatggtattacaccagaatctcaaactgatgccgccgctttaagacgagagttcttagacgaccaaatcacaatgctaacttgggcagacggagacttatcattttatcgtgacatcactaaacgtccggcaacttcaactgtagctaaatatgacgtatatctagcacatggacgtgtaggtcatactcgttttactcgtgaaatcggtgtagcaccaatttcagaccctaacttacgtcaaaaaacagttaacatgaaatatgtttctgatactaaaaatatgagtatcgcaacaggtttagttaacaacattgaagacccaatgcgtatcttgacagacgatgctatctcagttgttgctaaaacaattgaatgggcttctttctacggtgactctgacttatcagaaaacccagatgcaggttcaggtttagagttcgatggtttagctaaactaattgacaaacataatgtactagatgctaaaggtgctagcttaacagaagctttacttaaccaagcatcagtattagttggtaaaggttatggtacaccaacagatgcttatatgcctatcggtgttcaagcagacttcgttaaccaacaattagaccgccaagttcaagtaattagcgacaacggtcaaaacgctacaatgggattcaacgttaaaggttttaactctgcacgtggtttcattcgtttacacggttcaactgtaatggaattagaacaaattttagatgaaaatagtatgcaactccctaatgctcctcaaaaagcaactgttaaagctactttagaagcaggaacaaaaggtaaattccgtgatgaagatttaacaatcgacacagaatacaaagttgtagtagtatctgacgatgcagaatctgcaccatctgatgttgcatctgtagtaattgacgacaagaaaaaacaagttaaattagaaatcactattaataacatgtatcaagctcgtccacaatatgttgcaatttaccgtaaaggtttggaaacaggattgttctaccaaatcgctagagtacctgcaagtaaagcagttgacggagttatcacatttatcgatgtgaacgatgaaattcctgaaacagcggacgtattcgttggggaattaactccatcagtagttcacttgttcgagttactaccaatgatgcgcttaccattagcacaagttaatgcttctgtaacattcgcagtattatggtatggagctttagcattacgtgcacctaagaaatgggctcgcattaagaacgttaaatatattgcaacaggtaacgtatttaacgaacgctaatctttagaagactaagcaaaattgaataaaaatggaataggggacggttaatactgttccctatttttattataaaatacatgtatggaggaaataatatgttaaaatcagaaatcttaataaataaaacagtaacaacagcttttggtgaggtaacatttgaccataatggggaaaccacagacctaacagtagaacagcaagaacatttagggactaaagttccatatatacaatatataccagatgcacctaaagctaaagaaaaagaagctactgcagaaaaagcagacgaggcacctaaaaaggctaagaaagcgcctgctaagaaaactacaaaatctaaaaaagaggaagactaaggaggtatttatatgtacccagactacggatacgaggaacaaggggacaatacataccaataccaaccatatgcacatgggaaccctaagcatatagatttagacaaaattgatgatatacagcctgctgattatggttggacacctgctacgctgaaacaatacatgtttggtgtagaagttgttaaccctgaaacaggggagcctttaggagatactttctatgaacatatcatagattcagcaatagctaaagcagagaaacgactagatattgctattatgcctagacttataagaggagaacaccatgattaccaccaatcagatttcaactcttacatgtatactcatgtgtttaaaagacctattattcaagcagaaaagcttcaattagaagttaatggtagagggctatacagatacccgtctaattggtggaaagtgtatgcactagcaggtcatatacaaatgtacccaacatccctcatgcagactggaacacagtttggttatgaaatgacgttctcagggtacccacaattagcaggaatgcctccatcaggaggacaagttgatgctcctcaaatgattcatattgactatgtggcaggaatgctacctaggaaaaatagaggatacaatgaagactgggagtgccctgcggacttagaacagcttgtaataaaatatgcgttaaaagagatattccaacaatggggtagacttataattggtgcaggtattgctagtaagtcactaacagtagatggtattagtgaaagtatacaaacaacacagtctgctatgtatggtggagcttctgcagatattcgacaaattgacgaagacatacaagaattagaaaaatcattggtatcttactttggaatgaacttaggtattatttaaaaaagggggttaacaaatgggtgaaaaaccaattagatttggtggagcaggtgaaacaggtaaccctaacaagcaattaaatactagtagggttgaatttgaaacaaaaggtatggctagcttcattgaaaatagaggtattgacgttttgtgggaaagagcatggctatgtacatgtcgtaacccaatgaccctctcacctaagtcggattgccccatctgtaggggaagagggattgcttaccaacctgcagtaaaattaagaatggctatacagagtcaagagaaaggtatctctaatcaagatttaggactactagacacaggaaccgctattggaacgactgagctagattctaagataacctttagggacagaataacagtccccgaagttaaaatatatcaaagctttatttttaatgtaaataaaagaagagtagctaatggactatttttaagctatgatgtgaacagtatagaagatatttatggtaaagacggacgtatcttagttgatggagtcgattttagaatggactatgacacaaatactatttacccaaatgaatctttgatagatactaatatatccataaatatgtctgttacacttagatatattgttatagacctgttaaaagaaagcagataccagtataccacattcggtgttaaacaaacacaatttgagtcactacctaaaaagctcttattgaagcgtgaggacgtgtttattgatagtgaaccattttcattagacatagatacagcaagccgtatggaagagctagagggcaaaaaagatacaagtgaagctatggtagaccctaagcgtaaagctacaaaatcaggaggcttctttggaggtaaattaaatggctagaaaaggacagagacccgtattgtttactgattcaaaagcaatacttggcaatctaactcgtgcagtggttgatgaagtactaagtgatgcgcaagatgttgctctacgtaatgggtcttctgtacagagaatgcctagctatttgatagtaacagagtctaggatggcaaaaaatggggttatagacttgaaacctttctttgcacgttctaataaaaagaaatataataaaaaaggggaatggtacctatacatccctattagtatgaaaacacgcaacatgtcaagacgattatacgatgagttgagagcagttccagtaggcacaaaacctgtaactgttaaaatggactatctgtatgatagacgaaagcagagtccatcagtgtctagtattaactacaaacctaaatctactaatgtaactgttataccacagagttggggtaaaggtacacgtaacacctatgtagctttccgtacagttaacgctaattctcctgcgaatagttggataataaatcgtagaaacgttaatgatgatgatatgagtaagacaatgctaagaaacatagacaggctcatgaaatggaaactaaagaatttaggaggatagtgtatgataccaagtttagacacttacttgtataaagaatttgaagaaagactaaggataattctgtcagagtgctatattatagacgaagctttaaaggggatggacaaagaagctttagaatcttttaaaaacacttattgctctatagatggtaagccacctaagagagaagtagagatgtcctattcattcccacaagaacatctggattcatttgctcgatttgtagtaactctcggtagtagcgaagaagatagcaagtctattggaggaatccaaggaggctacgagtatcgagaaggtaatgtaattagtgaggaagccactattattagagaaggtgacaagctaattataaatacatcaaaaccagtagcggactatctaaacagctcagatataagttttgcagaaagcgaccattttaggattgaagataacaaacctgtatttgatttttcatataatgaggagttagaaggtatatccattaatgtgtcgtatataagcaaagtatcagatgatgatgttgcaggtgtatacaaaggataccaatctaacgataatgttagtataattggaataagttctaatatagatactgctaggtgtttagatgcaattgctagaattatactaatcaccatgagagacagtttagatgaaaaaacagggtatatgttgcaaacactacattttggtgatatgcaagttgtcatagaatcaggtgaaacacttgtgtttggtagaccttgtactgtaaactacagagttactaattctattggatttgatttacaacaaagaatcacagagattattacaaaaaggaggatgaaatcctagtggctaaagaaacagagaaagtagtaaaaaaagaagttaaaaaggagcaacctaaaaaacctaaaggttatgtccatgtcgatacatttttagattatgcaaaagtattatatggactaaataaatatcaggtagcgggtttcagagcactaatggcaggtagagaataccaacacgaggatgctgattttgttccatttttagaaaagtatataggaaaggaagttaaataataaatggctgtagaacaattcccaagaaaaaaagtatcacgtccacatactgagattaccgtagacacaagcggtattggtggggcatcaagtagctctgacaaaacattaatgttagtcggctctgctaaaggcggtaaaccagatactgtttatcgtttccgtaattatcaacaagctaaacaagtactacgtagtggagatttgctagatgctattgagttagcatggaatgcatctgacgttaataccgcatcagcaggagacattttagcagttcgtgttgaagatgctaaaaacgcaactcttacaaaaggtggtttaacatttgcttcaacaatttatggggtagatgcaaatgaaattcaagtagcattagaagacaacaatttaacacacacaaaaagattgactgttgcattttctaaagatggttataagaaagttttcgataacttaggtaaaattttctctatccaatataaaggtagtgaagctcaagccaactttacaattgcacaagataaaatcagtaagaaagcaacaacattaactttaaatgtaggtgctgaaccagaaagtacaacagaagtaatgaagtatgagttaggtcaaggtgtttactctgagacaaatgtcttagttagtgcaatcaatagtttaccagattgggaggctaagttcttccctataggtgacaaaaacttacctactgatgctttagaggcagtaaccaaagtagatgttaagacagaggctgtattcgtaggagctttagcaggagatattgctaaacagctagaatacaatgactatgtaactgtagctgtagatgctacaaaacctgtagaagactttgaattaacaaacttaacaggtggttctgacggaactgctcctgagtcttgggctaataaattcccattactagctaatgaaggtggttactacttagtaccattaacagataaacaagcagttcattctgaggctttagcttttgttaaagaccgtacagacaatggtgacccaatgcgtattatcgttggtggaggcactaatgaaacagtagaggaaagcattactcgtgcaacaaacttacgtgaccctagagcttctttagtaggcttctctggaactcgtaaaatggatgacggacgtttgcttaaattaccgggttacatgatggcttcacaaattgcaggtattgcaagtggtttagaagttggtgaagcaatcactttcaaacacttcaacgtaacatctgtagaccgtgtatttgaaagtagccagttagacatgttaaacgaaagtggagtaatctctatcgagtttgtacgtaaccgtactttaactgcattccgtgtagtacaggacgtaactacttacaatgacaaatctgacccagttaaaaatgaaatgtctgttggtgaagcaaacgacttcttagtttcagaattgaaaattgaactagataacaacttcatcggaactaaagtgattgacacaagcgcaagcttaatcaaaaactttatccaatcattcttagataacaaaaaacgtgctcgtgaaatccaagattacacaccggaagaagtacaagttgtcttagaaggtgacgtggcatcaatcagtatgactgtaatgcctatccgtagcttgaataagattactgttcagttagtatacaaacaacaaatcttaacagcatagagtgtaggggcagttgcccctcctcttacataatgaataaaatataggagtgatatatacatggctagtgttggaaatcaaacagtccacacaggtaacacagtttacctaatgattggtaataaaattatcggtcgtgcgcaatctgcatcaggtgagcgccaatatggtacacaaggtatctatgaaatcggtagtattatgccacaagaacacgtatacttgaaatatgaaggtacaattactttagaacgtatgcgtatgaaaaaagaagacttagcaagtttaggaattacagcgttaggtgaagacatcttacaacgtgatattatcgacatcgtaatgatggataatttaactaaagaaatcgtagtagcttatcgtggttgctctgcaatttcttactcagagtcattcacagctaacgaagttacatcagaatcaacccaattcacttaccttacaagtgcaaaagtaaaataacaataatgttaaccacccacattgtatgggtggttattttatgttatactatttgtattgaataaaaaaaagcttaaggagggcattagtagtgaaatatccatatttagtagaattgtatgcaaaacatgtaattagagactcagggtacatagaaaatgtaccaccagttatttatgaagacgttgtgaaacgtgttgaagaaataaaaagagaagaaaacttaacaatagattagctagtataagtttaaatagacctaattcagatataggtctattttttttgccactataaatacaaataactagatagtgtggtataataaagatagtgctatattaatttatgagtaaactaggaggaaataataatgacagaaaataatgaaaaggtatttacacctacaccaaatttatcacgtgagcaattaatagaaaagttgcaacgtggagaaaacttgacggatgaagaagtaaatattttgaaatattacaatgatgcagaagaacgtaaacagttagatagaattatcccgggtgttaatgatgtattttctaagcattataacttaaaagaatatggtttagaatttgatattaaaataaaagcacctaatattatcgaaaatggtaaaattcaggcaagaagagaagcctatttagaaggcatgggaatggcagttagcaactttattttccaaagttaccaaatgttagcaactattcgagtatgtggggtagaggtaccagaagtactagctgatgatgaaaaaatttataatttatatgtattaggagtaattgcaaaggactatggtgaatggctaaactcctttcgatactagagttaaagaactaggtggaataaaagccctcgttagaaataactatagtagaaatctatgggcaataatgaaaaaattcaaggtactaccgagtgaccctgcgtggcaaaatctcacaagtgaccaagtagagtggattttatataatatggaaagagacatagaagaacaagaacgactagctaaaggaatgcagttagaaagtgagttccaagactatgacgattcatggtatgataaaccacatgatgagttctccccaattcgtgaaggtgacgatgaggaagaaattgctcgtaaacttagtgaaatcacaagtgaggaagacatggctaaacttaaagctcgttgggaggcaagccaagaagttgatgctatccgtgcagaaggtggaacaacaattgaagaagatacgattaacgaacttattgctaacaatgttaaaaaagcaatggaagaggctagacgtattgagaaacatggtggaaacaaatggcaagagaaatcatcaattgagttagaagaggaacgtaagaacctagagtttaactcacagttgaaacaaggagatattcaggaggctattgatttgtttaacaaagatgtcgagccaacatcattagatgacgaatttcaaatttaagggtagggcattccctgccctttacttgtaaaggaagtgtggaaatgagcaacaattatcgtttttatgttgaggcaatgactggggatgctgttgcaaaacttaatgaaatagacaagttaatggataaaattgattcaaagagtgcaaagggcacccagaattttttccatacaagtcagaaagacattgataaagctgttgaggaaatgcaaaagcttatcaaggcaaaaaaagaactagatagggcttttgataatcagaagataaatgcagaaagcatgggagacatgacagcatataaacgtgctgtatcggatgcagaagaactaactagaagatttaacaagacacaaaaagaatttcaaaatcatgctagaatgcaagctaaccctaattacataaatgctagtacactaaggcaacaaaaggcatttcgtgatgagttaacagagcaagaaagagcgataagaaatatctctagggcacaacaggaactaaacagggtgaactctagggttaaccatcgtgcaaaccaagcaagcgcaacaggaagaatgacttacaatcagtcagagagtatgaagcgtgaccttagacgtactggtgtatttgaaagcctaggttcagaaaataaaagcagacagcaagagctacgagaacgatataaacagagacaagaagagctagcagagactagaagtaatacaaatttagatagacaagttcgtaagaatagagaaactagtattcaggctgagataaaagaaattgagaaagaaattgaagctagaaaacgcctagcagactctattaaagagactgtagagaacttaaaatctaaggaagcttcactaaatgcatctgacataaaagtagatgctgatagaaagagtattcgtggtgttctagctgagcgtgcaccttctatatcaatggctatgctaggaggtaccgccgccgccataggtggtttatacgcaaaaggagcaactgctaatgcaggtatgcgtgatgcatctatatctttaggacaacgtacaggtactagtgatttccgtgcattaagaaaaagtatgcaagagatgggtattgagaaacagttaggctataaaggtgctgacatgttacaattccaagaagatgcattgagtaatattggttttacaagtaaagaggacttagcaggaagtacaagagccttagcagagggttcaagggcagttccagtagacaatgagactttaagtgacttcatgaatagccaaatgaagagtggagctattagtggtagagaccaaattaagaatattcaagaaggtttcttaggtgctatccaacgctcagggatggcaggtcgtgagaaagaacaactagaagctcttaaaacattaagtgagcaaagctttactggtcgtaacggaagtaatcaagagcttaaagaacaaatggcaatgttaacaatgctaaaccaaacaggtaagcgtgctgttcaaggtgaacaaggggcgcagttaatgtcaagtttatctgcaggtattcaaggtagtgtatggaacaataaggcatctttacttttaggtaaagggacacaattccaaggactagcaggaatgtacgacttaaaagctatgcaagaacaaggagcaacaccagagaacttacagaaaattattggcagtgtccaacaatcagttcccggtgacgaaaagtctcagaagtatgctttcggtagtgctttacacgaactattcggcacagatgctaagaatgaccaaatagatgcaatttgggaggcttatgccaacggtggtttaagtcaggataacgtagacagaataatgaatgaaagccaatctacaggaaaaggcaaatacgacaagaacatagaagactatgcaaactctaaagaaggaaccgctaaccgttcagaagctgttacagagaaacaagcttcacagattaacgatatgggggacatcttaagagaaactaactctaaattaggagcacttcctcctgcgttatatgcgttaggagcaggcttaggagctatggctgtttcactagccacatcaggctctattggtggtttatctagtttaatcaaaaaaggaactcgttctacttttagtacaggtggaggagtaactgcagggggcggatttttaaaatcagctaaagaagcattctctgcaggtaaaggctctggcggatggttccaaggtattaaaaatgtaggtagtgtagctaaggactccgcaatgggtgtcggagctaaggctgttgaaggagcaaaaggactaaaaggtgccggaatgggcagtaaggttcttggtggcttaggaaaagcaggtaaattcctaggcaaagttgcaacccctctagcgataggttcctctctactagatattgcaaccgcagatgataaaacaaaggcggtaggggagagtgttggagctattggtggaggtatcggaggagctaagttaggggcaatgattggtacatttattgcacccggtcttggtacaggtatcggaggagctattggtggaggtatcggcgccataggaggtactctagcaggttctaaactaggcggtaaatttgttgatggtgttcgtaaattcttcggaggagaagaagctcatgcggaagaagcagacttaactgcagggcaagatgttgcttctgggcaagagagtaaatcaggagtacaagaagccagagacacggctaacaaacgagtcctatctgagaaaacacgtgcagagaataacgcagaagagtccgccaatctctctatctattctaagttattagatagagcccaacgtatactaaaccaagcaaaaaatcaaaacggtatattcggtaactcagggagctctaaagattcttctgatggaatgggttcagatgcttctagtaaagactttggaggagactgggagaaagccattaggcaagcatctaagaaaatgggagtagatgtttctgacgatgaaatagatacaatacttagattgattcaggcggagtctagtggtgacgagagtgctgttcaacagataattgatgagaacaacttcaatggcaatggcggagctaaaggtttgctacagtatgtccaaagtacttttgatgcatacaaagtagacggtcatgacaacataatgagcgggtatgaccaattgctagctttctttaataatagtaattggaaaaatgacctaaattcttgggatagccgttatcaaaacggtggtacaggatggggtcctactggtaataaaactagagcgatgggcggacacataactagcccagagtatgcgctactgggagaggtagcaggtcaagatgagtatgttataaatcctagtcagccaacagctccacgtttattagcagaagctactagaaaaacagctcaaaacttccgattaacaggtaacggttctggtcatgattggggagcttcaatttctaaaataaatgcaacaggaggagctcaatcaggttcagctcctacgatgacaaatacaaatgaggtatcagttaatgtcaccatacaaggtgggggaacaagtgatagtatagctagagaaattggtgataagtcagcaggaattatcagcaaaacactcgatgccaccttcacagatttcttcgcaaaagaatacaggagagtgtagaggcttaatgtctctacttttctctaaggaggtttataatgtcagtagagttaagatacccgagatttgatttaactttttttacagagacagacaactaccatatagtttatgatgcaaaagatgggcttactggacgtaataacaataacggtgaaacagagaaggtaagcaataattttatggcagagtctgtaattagtttaactacaaaaaatgctttagaagatgatagtgcagtcttctccttcgtattagcaggggatgtgtattgggatagagtgctaaatgctaatgatgcagttattcttaaaatagacccagatacttcctccactaaaaaatcagataaccctgtactactagttggcttaatatctgaggtcagactagagggtgactatggagagaactctaagatgtacaggataacaggacagtcttttgcaaaggcattaatgcagttcgacttaggtgttattcaggaagtaagtgtagttttgacagacttaggttggttacctgacgatgcacaagaaggtataaaaatgtctggtagtagtgcaagtcaaatagcagaaagcctaatgaaaagatttttacaatatatgaaatttaattttaatggtcaaggtatagataagttcttagagtgggagctagatagttggacagaggcggagagactaatagatagtaccccttacataaactatgaaggttctttaaagcaacttatagatgatgtaaccgctaaaccgtttaacgaattgtatttcgatgcaacaccagaggggaaatgcagaatgattatgcgtagaaccccatttgataaatctgattgggaaaaattacaaacctacacagtaacatctgcagaagtaatatccgaatctgtagcagttaacgatacagaagcttactctatatttaacatatctattaataatttgtatgggactgactctatgatgttaggttctaaaccacaagtattccctgatttagtttctaaatatggttataagaaactagaagtacctaataggtatttagaaggagcaattatagataagagtaacagtggggataaagctaacacaaaacccgaaagtggtaatgatagtaaagagagtgatggctcaacagctaaacagatgtttgacagagagtacgctcttgtcttaaactatctaaaagggtatcctgttgatgtgctaagagttaaaaaaagtaatgtaaggacatcaataacacaagtagacagacgtataacagataacgaagcagataaaattatagaccactatattacaaatcaagcattaagtaaagaagacttttctaaatttacaggaataaccgaagaaaatatagaagagggtaacggtaaagtagagcctacatataccgcagttagggacttccttaatgggttagataaaaacctaggagtatctagcataaaagagaaattaatgaactacttcaatttgatacctaaccaagccacatctattgctagtgaatacaaagcacaaggtaacttaggtaaactaaaatatgaagaaataatggagaataacccaagtgatagctcaaccgtcactggttcagataaacgatttgtttctgagttcactaaaagactagcaaattggtactgtgaaaacgctaatttctacagtggggatattgtagttaaaggtgaccctaaatatagattaggtaaccgtttgtttgttcaagatgagcaaaatggtgagttgtgggaatactacatagaatcagtagaacactcgttctcctatacacaagggtatatcactactcttggggtcactagaggtttacaaaatggaggaaacgatagattcactcatttatggggtaaatctgaggacttctccggaggtatgctaggtgagaaaaccttgcaagcactactagacgaacaagcagaagcaaacagtaaaaatgatggaggctctgatagtggaggtagctcaggtaaagagtatacagcaggtgcaggaactcagctagcggtattcccattagacgtaattaatgtaactcagggagaaaatggcggatacagccacatgggagcacttgcaatagacttttcagatggtactcctcataaaccttactatgcaccatttgactgtgaatgtgtgtacactgactcttactcaggggttgcatggcaatctcaaaagcctgttaaatgtgtagatggtagcgttacttacgtaacactattatgcgtacacgacaacaactgggcaagcaacaaagtaggggataagaaagctaaaggggaagtaatagggcactcagggactgcaggacaagcatcaggagaccatgcccacttcgaggtgtctaaaggtaaatggcaaggttggagcacaagcagtgcgggagtttactttataaaaaatccttctcatttatacgatgtattttctataaaaaataatgtaactggaaaaacaactaaaattatgaatggtggagggtacaattggcgtagtatagactgggacgataaatctggttcaggttctggaaagaaaaagacagttggtgctagagccatggctactccattcggattacgtatgatgcgtagcgctcctgtagaaccagaagaaccaaaagttgttaaacaagtagaaactaaaacagttgttgaaaagaaaccaaaagtagaagttaaaaagctcccaatactttacgggaataacattgccacagaagcaactaaatggggaagagctcactcgaaaacagagtccacattccaatctgccttcaattttggagctaatacagataaagacccatttgaggaagacattatagcaacagacagtgcaggatttgtttggtggtgtttctaccatgcaggcatatcactatctggtggagctagaatggttaccactcgttcactactctatgataaccaattacaaactatctctactagaggtcagaagtctttagagctatttgataagatgaaggtaggagatttagtttggtttaacagagctagtcatgtagggatatattgtggtgagggcaagatggtctcttgtaatggaaaaggtaacatggatgagtccccaaaaacaggtattgttattgtcgacatgtctaaaggttattggtggaacgcttttgacggaaatgtacgtagatataaataaccctattttttagggttattttttttgtataggtagtttttagttattgtgctataatagataatgaggacacatgatgagaggatgaataaattggtaaaacgtagatttcaagcaggtctaggctcagaaattaaaagagtatataaagaaggacaacaaattaacacgctactattagcacaagtaattcaagtaaactataaatataatacagtagacctactagctttacagcacaaagaagtatttcaaaattcttatgcaaatgagggtcgtttctctgcaagacttcctatggaatttggcggtagaaatatcgttggacagccttatgggcaggttaacccgatagcagtaggaacagtagtattagttggttttattaattccgataaagacatgcctattgtaattagtgtttataataataacgatgtaagcaaacagctttcaagaacacaattttcaaattcagaccctaaagatttagagttaattggggatatgcaccaaaaatttagtttgtacccttcattgacatatgatagcgttgatggagaaggaggacgtgtcgttactttttctggtaaatcatttattgcttttgatacaaaagaagtagctaactcctctacaactgatgcaggttatggtactaaatatgaggacttagagacatcatactataataatggtgacctaatagagcctatgaaaggtagagcaccaaatgtactgtttaagcatcaaggggtacttgacgatgatggcaaaccagatttgcacgatttgctaattcatattaacccagatggtacttatagaacttctatgatgaacaaagaagaggattggcgcacactatttgaaatgacaccagatggcagagttaaattaagaaaacaagactctattaatattgatggtggtatagaaataagtgagctaggaatcaataatgaggggttcgtttatttacgtaatggggacatggatttagaagtacgaaaagacggtatctattcacaagggaaactgtttacagccgatgtagacctatccgatgtatatgacaaactaaatgggttgtctatacagattaaggaaacaaatggtcaattagagattatagctaatggtgtagaagaacaaaatggaaaaatatcagaactttctacagaaataacaattgtagcaggtaaagttgaatcaaaagtaacaaagacagaagttcaggatatgattgacagttcttttgtagatatgtctgatgcgattaaaaaagcacaagaagatgctgacaaagcaaataaagtgattgcagatatgtctagtgataacaggttgactccaagtgaaaaaatagatttattaaaagaatgggatattataaaaaatgaatatccaagctatcttgaacaagcagagacctacgaggttgacagtaaagactacactgctaagtacaattcattagagctatttgttacccctatattggctgatatggaatcaactagctcggtagacggagcaacacttcgcaaaacgtttaattcttactatacagcaagaatagctttactaaactctattagtaaaaaactaaaagacggtatcacagaggctatgaaaaaagcatcccaagcatcactagatgcaacacaagcaatggcagatgcctcacaagctaagattgatgcagataatgctaacaaacttatatctgatatagcaagtgataacaagctaacaccttctgaaaaataccaacttaaaaaggaatgggatgtaattgttaaggaataccctacaacaattgcacaagcagagaagtacgcagtagacacagcagagtatacagctaaatataaagccctagagctgtttgtagagcctttgtttaaagacatggatgaaactagtatagtagacggagaacgccttagagcgacattctcggactattacgcaagtaagattgctttactaaaagaagtaacggactcagctaaaacagagctagatgcctatggtaataaaatatctgtaatggaaacaaacattactcaaacatcagaagctattactttactagctactagagtacaaactgtagaagacggtgtacaatcgaataaggcacaaatcgaaatacaagctgaacaaattagtcaaaaagtaactgctagtgaggttaaaggaattgtagacgattctattaacaatctaacattaggtggaactaacttatttgttataaagacacagacagcaggtttactaaacgagaatgatggaactgtaggtactgcagtagacaactcagtagtgtcagactacattaaagttaatcaaaaaacaccatatattgctacactttacggtaacactggcacaaacatgattataacagactggtacgataaaaatagaacatttatttctggggaagctgtggcagactctggggattttagtaaaaagtatgtgtcacccgagaacgcagtttatgctagagtaagttataagaaagcaaactctgtgaatatcaaattcgaggcaggtacaaaggctactgattacagcccttcatgggaagacataaaaggtgaccaaactgctttagaggaatacattaaaaaagtagaagaacaagccaagaaagctcaacaagatgctgaaaatgctaaaaatgatgctgaaaatgcaaataacgcaatagctgacatgtcgaatgacaatatgttagcaccgaatgagaaaaaacaaatactcttacaatgggaacagattaaaacagagtatccaataaacttagaccaagcaactaaatttggggtgtcttctcaacagtatacaacagcatataacgcactagacgagtacttaaaaccaatactagctgatatgacaacaacttctgtagtagttggttctactttaagaaatacgtttaacaattactatgacaaaagaactactttgctaaacagaatatctgacgtagcaaaaaatgtagcagataaggcgcaagaaactgcagatactatcaatgataatttacaaaatattggtgggtacaactatgtagggttctcttccggagacaatatgttgcctagactgatgattaaaaacgttggttactacacattaggttcgtcaaccacagagttcattgacagcatggtagctgtaaaaggtgatgcaacgacccaacctttcgattatactgtaggtacttctgataaagaaattgctggtggcggtttagctgattaccgtatgaaagaagtaaaagaaggtcagtggctaacagcttctgcaaatgtgcaggtaataggtggtggctccgctagattagctatctacactttagaaggggataactgggtaggctctaatagtacacctatacaagtaagtgatggtttgaaacgtgttgtggctcaaagaaaagtaacaggcttaacaaaaggtgtgttaatacgtattgagtcagcagacactaatgttaaagagtttcgatttggtaatgttcaactagaagttggtattatcccaactccttggaaaaagtctgatatagatattcaagaggacataaacaatgttgttcagaatatcaaaacatacactgcttgggctaacgatttacagggtcttgattttacaagagaaaaggttgaaggaaaaacttacatgtatgtaggtacctctatgaaagatagtgataactattcagattatacatggaggctaactgatgaacatatagaaggtcagattaatggtaaggaaggcgcatggatttattctccaacagctcctactaacccatcgcaagggcttatatgggtagacttgtcaaaagtacctaaccaacctaagcgttgggtagactcagaaactgggtgggttgcattaacaccagaaggggttaaagatttaccttggggtgaagacggcacaaacttagctgactgggtagcacaagcagagcagagaatatcttctgatagcattataaatactgtactaggttctgaggattttactagtgtgttcgatacaaaagctaacactactgacctagacaacttagctacctatgaagatttagactcaataaaagaggactataaccgactaatcaaagaaggtataaacggtattgattttaccccttatgtaactaactccgaactacaacagcttaaagacagctttaacttctctgttcaacaagccggaggggttaacatgcttaaaaactctttaggattctctgggttagacttctgggatggtacagtagggaagaacttattacctaactctacttggaatttaggtttcggtagatggggtggcgcttcaatcgctagttttgaaatattaccaccagaagacgacaagcctacaagtcatatactgggttcaataggttctcgttcttctactaaagaaataggtaatagaccccacccattaaaagttaactctggtgaaacgtatacaataagctttgattataaagaagaggcattggcttatgataaggacagacctatccttgttgttagaaactaccctgataaggacacagaccaatggatggagtactcaatagaaggttgggcagtaatggctaacggaagcactactgacttaactgtttggagacgttttacaaaaacatttacaataggtactagtggctacttagatattttacctaaaactatagtagaatcatggacacacaggtctttttggagagagctaaaaatagaggaagggtcacaagctactacttgggtacctaacaaggaagacggggcgtttaccggtggtattgttgaaactacccaaacagaagaactagctaaccttgggttcggttcgggatttgttagttctaaaagacctagctcttcactaacacaatctgtagaactacctgaaataggcgctaaccttgagtattcactatctttttatatgaaggtaactacagacaatcctgtagccgactttaaatgcggtattcgggtttatgagggagatactctaacttatacattaggcatagaagatgcaacacagccaataccactagggttccaacaatacaagcttgtgttcactcccacaagtacctctactaaaatagaaatgtttgtagagaatggacaagaggcatctgttattatatcaggtattatgtataatatcgggaatatacctcttaaatggcaaccatatccaagtgagatatacaatacgaatgttaagattgatattaatggggtaactgttaaaaacaatcaaacagatgggtacacaatgattaccccccaagagttctcaggatattctcgtattgatggtaacatagaacgtattttcactttaaatgggcaggtaacagaagttaaaatgctaaaggctgaaaaacgtataactatggaaccagtatctgtgtttgctatgaatacagtaacagatacaaaaagaattagaggttgggcatttgtaccatcatttgaataaataattcaactttttaaccgaaaacttcacttacaagtcgttttcggttaatttgtgttatactatatagagaaggacacgaaaggacgatgagactatatggctttaaacggaacaaagtatacagcctttgcccgacatagattagttttagagtggcgtgcaaatcaaaacattgcagggaactactcaacaatcagcgtatggctatacctacaatctatggataaatggggtagacttgatgctcccgctatcggtgatgccaaagttaccgtagacggaactacacagacagaaaaagcttcctctatgttaaatgctttccaaaagaaactattactagctaaagagtggagagttaatcataataatgacggttccaaaagaataactattggaggtagctactttgtaaacgttacttttactgataacggtgtaccaacatattatggtaccataactatacctaatttttcagtagacctaaatagaatacctagaagaagttcattaaaccctgtccctacattaaatttaccggggaacttaccgataacaataaatagacagagctccacattcaaacataatctaactgcttgggtggctaacagagataaccccacattaaacaatgatgaccattggacgtacttgacaaaccttaatgatgtaggcactagtggagcgtttagttttacagtagcaaataacaaaactatttttactgcattaaacaatagaactagttggcaaggcaaggttaaactctggactatagggttagatgatgtagttagtcaggaaagaacatacaagattgtccccccaatgaatgcacaagcatcgggaggtaagataaccttaaatgtgggagagaaaatcaatgtatcactaagtaactatcggtctgatgcaaactttacttatgatggggtatttaacattagtgggctcaacatacctattgctacaaattcagcagggaacacaatgtcgtatacactaactcaaacagatgtagacaatatattgaagaaaataccaaatgcggattcctcgtggggtcaagtaactgtaacaagtaagtatagtggagtacaatacaggactccatggacaggacagagaatagatataactatacctaaaaacaagtatgtaccaagcattaatggtacccctacttatgaagatacaagtaatgtctctgtcgggcttacaggtaacaatcaggtagcccttcaaggtaagtctaatatcaaagtgactatccctgctaactttgcaacggctaatggttactctactttgaaaacaattgatgtgtctttaggtggtacatcaaaaacaatcaactattcaaatgcagaaacagttgtagaattaggagcacctgctaaccatacgtcagatacattaatagtcacagtaactgacagtcgtgggtttaagtctaactggacaaaacatgtagacatttatccctatgaaaatccaaatatggactttacagtcgcacgtagaaataactttgagacaactacagatattaatgtcaatagtacatggtctcctatcactataggtggtgtaaacaaaaatgctatccaatcagtaacctacgcaacaaaagtagcaggtgttggtacttatggagcagaaactgctttaaattttacagctaatggtagtatggtaacagtaaaaaatacaccaatagaattagataataccaatatatacgaagttaggttgagtgtaactgataagtttagtacgtttactagaacagctactgttaaaccgggtaaccctatcatgtttattgatgccgataatcgaagtctgtttttaggtaatgcctttgttgacaataacaataatgagctaagaggcttattagagatagaaagagataagtggcaggagaatggtttagtaggaatatccttaaacaacagtgatatatcagcagtcaatggcatatggttctcgacagatacatcaaataacggaggtgaaggagttcactttattaaatcaggtaaaccaagaaactccttaaagtgggaggactatgactacgtttatatgagggacaatggattctatgttaacaatgactctaatcctatatttgaagtttctgacactggtacgatgacgtttcctactaaacagctttggaaaggggctgcctatttaaacgaaaaacaagaagttttacctagcaaaaaattaacagagtgccgaaacggatgggttttgaccttctccgcatatgagtcaggtgcagggcaaccttgggatataactcaggtatttattcacaagtctgtactagaccagtttaacacaagagggtttagggctataataggtcatggaactacgataacatttaaatatatgtatataactgacggtcgtattggtggtaatgttaataatgggacaggagttaacaatggcattgttataagggaggtatcagaatggtagaagaaactcaaaaaatatttgtaacactagatgataaagattttgttagtaactggggaacgtcactcaatagtgatgaacctgtctatgaagtagatttgccaatggattctccattcttttcacattactattcaaattgttttcagtatgtagatggagagctagtcctaagtgaagaaaagttattaaaagtagagttactagcagtagccagtaagtttaaaagggactgtgaagagacctacatattgcaaaaagttccttatacaatatcaggcactacctacttatttgatgttattagcgatgatgagtttattaataaaataactctactagacaataaaattcaagattatgttggaataactgcttatgctacatcagatggttctcaattgatacttaaatttgataagtcccaatatactactatgactagatatattaaaaaagtagttgagtctagggaaaataaattaaataataaattacttcctatgattgaaaatgctaagtctgtagaagaagccaaagaaatttcttggagttctgtacctgatgagttgctaccagagcaagagagtaatgaacctcaagatgagcaaagtatagatagtttaattaaagaaaataaagaattaagacaaaaagtagaatttaatgaactagctttaatggatgcaataaacatgttttctgaaatgaacaagtaagttattattaactaaaggaggtaatatttctatgtacccatacttatcaatgttatatgcatcttatgtaatcaaagaccctgagaactatcctttagagaaggttccggcactaattagagaagatgtggagaaaatcgtggaagagatggcaaaaaagaacgaaaaacaaggatagttaatttagtaattggagtaacaataggtttaatcatagggctactaatttaaactaatataaatgagggtagtttgtgctaccctcttttttatactatattgtactatattaaggaacgaaaggagcggttactatgggacaatcagatggtatgggcggtacattaaaacgtattgcgattcaagtaggtaacgacccaaataaaggttggtatcgatttcaagtaaacccaactcaatataaatataataagccacatcgtgttactatatttaaaactaaatcaaacattataacagaagactttggtaaagacatagaaactatccaattttctggtacaacaggattcagggtagacagcagaggtaaaaacggggcggacagactaaaagaattagaagagataatagataattatgcaaaacagggtggtaatgggaataggtctagcgtagagatgaaattttataatttcacagacgataaatattttgttgttcatttagcaccagaagggctatccattgaacgttctgcagaacagccattattatttaattacaccttaagtttagtcgtgttaagagaggcaggacagccctctgagagagctcaagtaagccctcaaataggtaatgtaagtcctagcattggacggacatacaatgcacaacaggacactagaacacctgctcaaatacttcatgatgaatataggagaagtgttatgccaaatacagcagtaaatcctgcagtaacatcaggagcctacaactatggtgtaaatgagttaaaaaaaataatcggatatggagggtagctcatggaaaaagtagaacaatccgcagatttgctaagattttttagatatttaaatgtcgatattaacggtgaagttgtagccaatgttattgacgaccaaccaaactttatatcaaggttctacacccctcatacacgagttaataaaatatctagtacactattagatattgtgcgagataacgatataggggaaacaaataaggctttgtctaaagactccttaacctacaaatttttaaaaagtgggcttaagctttcatctccacgtatttacgaactagcacaaattgtagtattagaatcctttgctcttatatatgctatcgaagaagaaccagagatgtttaaaatgattaacgaatcagatgtaaagcagactagagaaaatgttaaatacttaattgactgtttagggggagcaaaagactatacagacatagtgatggacttacaatctatggatgtcgctctaggatatattcaggagcaagttcctttaatacaaggaggtttaccagtaaatggcacgatataaaaagcatttaattgtatatggagatacaatgcaatccatagcacaaaaagaaacaggctctgtagataattgggtaaaaattgcggagtacaacgacttagtttacccttacatagtagatactatgcaagaaaaaatgagcaacttagaacatctagctacacttggagacaccctttttatacctgatgaaggtaacttattggacattaacacaagctcattaaaccaaagagatatggatttcttattaggcttagctttaggtaaagatttggatatgacaagtgatacagattactatgagaatcatggaacaagtgatgaagtgtttgcaataacacataatgggcatggtgacttgaagatagctagtggggcagacaatattaagcaagccactatatcaagattgatgacagctaagggttctcttatgttgcacccagagtatggtagtgacttgcacttaatgttcggtaaaacaacaattgaacaaatgaagataattagtatagaagtatgcgatacagtacttaaagatacacgagtagcagaatgcgttctagtgaaccattatattgaagaagaccgatatgttggtaactatagagcaaccttacagtctactagagagcaatttgagtttgttgttcaaaacgataactcaggggctctaattattgtatagaaaggataaggtttaatgagactaaagaaaatttcagagatactaggtagactaattgatgtaactatgataaacacacatgagataaacgatttctcagttggttctactattcgttctatttatgaagctgtttctatggagttagaacagtactatattttaggtagagagaatattttatggggaattgaacaaggagtcctaaatgcttttgactttaggaaaagagaagcaaaaagagcgtatggtatggtaacactagagttccatacggttactcagacccctgtgtatgtaccaacagggacaacgttcgactctagcttgtctggtgcccctagcacgttaacattccaaacgatgcaagactacataattccagaaggtgttataacagcaaaggtagaagtttattgtacaactgtaggtacaaaagggaacatacctaaaggaagaatcaatcgggtaattaacaatatatcaaacttaaaaaccgtgtataatgagtttgattttttaacaggtactgatgaggaaagtatagaatccgttaaaaaaagatttcatgcatttgtggaatcacgtggtagagcaacgataaaagccttagactacggtacacgtcaagtagaggaagttgcaggagtttatatcaaagaagaagtaggttacgttagaatatacgcacatgatttaaacggtgatttaaaacaagaaacactagataaaataaaagtagctattgaggactacagacctgcaggcattaaactggatgtattccctgtaataaaatccaatgtacaagtgagtgcaactgttactataagtgacaaatcgagaataaatagtaaattagaagaaagagtggagcttacaataagaaactacttaaatagtcaagttgtttcacaaccattaatcttagctgacctaattcaggttataatgaatattgacgatgttttaatctatgactgtaaaattaacaacatggaagggaacatggctgttagggacgaagagataattcgtgcaggagaggttattgtagaactgatataaattaggaggaatataatgtgagtaacttttataaaaatatccaccctctgttgagacgtggtaagaaacctaacaagtatgatgatactaactttgcagtgcttaatgcgttgaactatgaattaactcaggcagagcaggagaccattgctagtaagattcattcttcattagaaacagctacaggtgagtacctagatacttggggggactggtttggtgtatatcgtaaagatgattggaatgacgaatattataggaaaagaattataagagaacttttactaaaaagagccacaattcctgctatcattgatgcgttattggatttccttaacgacaatgatgcagtcatccaaatatatgaaccttggagaaacattttctatacaaataagtcaaaattaaacggtgacgaccatttaatgggttactactaccgttttgcaattatcgatatttcaattgatagaccgtttcctcctgaaattgtagagattattaaggctttcaaacctgcgggagttctattttatctaaggctagacacaagcttaaataagaataaaacaactgtagaaagcccatatgtatacctagacgtgacgaataagacagaattagagttccttaacggtttatactatgacctacgaggtaacattaacctgtctgaccaacgtacacaagtagtagagagtaatatcttccatacgaataactctatgctaaacggggaagatgtgcttgcaggggcatttgaccatggaagaggttacatccacttagcaagtacgacattgcttgagtacacaccaaaacctactgactctatgagtgacttaaaaacagctctaggagagtcaggtgctgacatgtataatcaaacaaaagaaaaggatggaagaacagcttatattcaagtacctgcaacaaagaatatccacactttatattcaaacagtacagactttagtgattacgattactcgggaaaccctaacgtgattgtaacaaatgctaatacgttcaaatcaggaactggcggaactcttacctataacagcggggagtacactgttttgatggatgggtcagatagattaaataaatttaataccgatggggagaatagtgtatacctagaagataaagcgacctatacaatttcttgtgagatgtatatcggttctgactatactgggaatgccgaccaagtatttgctaactatgcatatcttgatggaggttacactttactgcaaacaacaagacttcctgcgaatgctcctagggatacttggataacagtaaaaggaacgtctaccatgaattaccaagggatggcacctaaagtattatacttgagttggcaaacagttgcaagtgatactaacccaaccggtacgcttaagatgagaaatataaaaattgaacgtggggaaactaatactccgtatcaacctaatttattaggggcaccttggtatttaggtaaatttccattaggaaaaaaccttgcagaccctacagttaagttcccaataaacacgagtgaatataagctatatcaaggtgatatgtcagagccgtttagagttggggaaacgtatacagttactattgaaggtataaaacctactaaaaataaatttggtgtgtataatgcaggcacagttttattaggatttttacatcctgtagagggtttacctaatacatggactgggacatttaaagtacctgcagtaaacgcagaataccctaatagactgcaactatatcaattatcaaacgataatgactatggtgctgttaaaattgactggcttaagattgaaaaaggaggtactagaactcctaacattgactcctacaactatgtaggcactctggtagaagatacagaaacctctacagtagacccaactaagtacacatggacagtatatggaagtataacaaataaaaaagcatatatagtattcgatgttaaaacttttatcgaagaaaattatgctatggaatttgaaaagcttattgctgacctaggagaagaccaagcattaaatactgtgtttgaaaactttaacatctctacagcacttaaggctctagtaagtccaagttcaccaattagtttctcggttgaactatacgatttttctacgagtgcatggcacaagttaaacacggatagtttagacttacgtatgcgtacattcaacttagtagcaaaccgtatcacagactatctaaatgattacaagctattatttgttcgttacgtgttcgataacgaaacagataaagatgcaacggttgaactagacatgttaaatgtactgttcaaataccgtttaggtgaagggtacagtataggactacaatcatctgtggaatcactaacggaactcgttcctatagaagggtaatagcaaataatatgttataatataaatagggcacctagttgtgtcctattttttaataaacatgctatattaacaattgaatgataaagaaaagaggtaaataatgtggctattgcaactaacaattcacgagtgtatgcctcactccaattaaaaaataaacaagacagtatgtacctagcaattggtaaaaccactccttggactaatgaagatgcccctcctgcaccagaccctaatacgactactctaacagaggttattggttataaaaaggtagcaagagtatctttatgtagagaatatctaccaagtgatgattctaaataccctgtggtgtcctatggttcaagaaaatttacgctaattccagatgaggacggctataaagagcaagcatggatggtgtatgtagaagcagaaattacgggagatgaactaccaacaggaacatttagacaagtaggcattcatactgacttagtgtctaaggcaagttcagaaaagaaagctttgttacctacagatgtaacagatgcaggcattttgcaattttttgaaaacagacagcaacaaaatagaacaagtgatgtaattttaaaagagaagtttattattacaatggaaaataagaagtcagttaaacaataggaagggtgacatagatggctaaaaatattacaaatgatgatttaggtaaagagccttataacaatagatattaccaaggcaaacgattttcaggtttactatttaaaccagataagccgttacaacaagccgagttaaacgagttacagtcaattattcaaggagatttaggtaatgtggctgaatccatatttagtgacggtgacatccagactggtatggaatatgtgctacaagataagaagcttactattaaaaaaggtaaagtattcttaggcggtaaaatgcgtaactttgacgaacagagtatcgatattaccggagagggtacggagtatgtaggtgttaaacttgtacaaaaagttattacagcagaagacgacccatcactgttagaccaaacaagtggtgttcctagccatttctcagaaggggctgaccgattagacgaagatgtagtactagcagttaacgatgattctgcatcaaacatttaccactttgttaacggtgagttatacattaacccagatactcctgagatggataagattaataaaatactagcagaaagaacttatgatgaatctggttcatatcgtgttcgtggttttgatatgtatacagaagtccacccaacagaccctaacaataaaattcagttagttgtcgattcaggtcgggcatatgttttaggttttaaagtagataaacctacaactactcgtattgatattgaaaagtcaagagagctagaaacaatcaataacgaaggtttctactatagcaatgcaactcgtaaaaacaaattaggtaattccccagtatcttctgtagaccgtgtaactgcacaagttgaagttgccaaagaacaggtttctcgtggggtcgtaggtggaggtaccgattatcttaaaaacacctctgtaacaaaagttatccgtgtatggactgagggttcaggagcacaggagtacaaacaaggtgaggacttccaattagtaaatggtcaagcaatatcttgggcacctacagggcaagaacctcctgcagggggaacctacttcgttcaatatgtttataataaaacaatgattgaaaatacagattacaaagttgtaattactggtgaaggcgatgctagggaatggtacattgactttaacgagatgacaggttctaaaccagtcgatgaatcacttgttaacgtagactataaatacttcttagctcgtaaagacctaattgtactagaccataatggaaactttactgttcataaaggacaacctaacgctttaagactagtagaggcacctaaccatgtagacccattagttttagctattggtacagtagtagtttacccagactcaaatactgctgatgctaaacaatggacaatcacacgtctaacaatggaagagctacagaagttatctgttcgtgtggaaaacatggagtataaccaagcagtattctacttagaccaaccggcaatggcaggagaaaaccctatctatctacgtggagtattctcggatgcgtttatctcactagataaatatgacgttagtcacccagatgccacaattgcttttgactttgacacagcagaaataacattgccttatgcagaaattaataaaacagttccaacaatcatcgaaggttctagcgaagcacatgtgtggggtagactagtaacagcaccgtttaccgaagaagtgggtattagacaaccatttgctacggaagcaatgaacgttaacccatacaacacctttaacaaacagggtgccttaaagctaaacccttctgcagataactggattgaagatgaacgtatcacagttaccaaagaagaaacatctactatgactgttcgtcaatggtggagacatggtggagcatcttggacaaacgatgagatgaacatggtatccaacatcacgctcgaccccggacaatcgtggggaggtgcctctggtacagaagaccaacgtaaacaagggctatccggttctactttaaccagtggtggtcagcaaaccaaagaatcaatgattgagtttatgagacaaattgatgttgaggtttacgcagagaacttgcaacctaatgctaataacctatacgtaacatttgacggcttgagagtacctgttaccccatcttctggttaccgtaaaggtgccacagaaggtactggtatggcaaatgcagacggaacatttaaaggggtatttaaaatacctgcaggagttcgttgtggtactcgtgaggtatctgttagaaacgatacgaacttagcaagtactacgttcactgcacaaggtacgttaaaaacaaccgaggatattatcataaaaacacatgttactattaacttggttgacccactggcacaatcattcagttttaacactaacagagttgcaacaagctttgacgtattctttgcatctaaggataacagtacaaatattatttgtcaagtacgtggaatatcagaaggtgggcaacctaacaaaactgtgtatgctgaaagagtgttaaaaccttctgaaataaaagtatcagatgatgcaagtgttcctacgaaaatcagctttgatgacccactaatgtgtaaagcaggtcaagaatactgtttagtattcattactgactctgataaatacacaatgtggattgcaactatgggtcaaaatagagtagacgaaccaacacaaacagtaacatcaaatccttacttggaaggtgtcctatatagttcatctaacgcaagtgcatggtctattcaccaactgtctgatttgaagttcactgtatacacggctaaatttaacgaagaagcggtacttgagttcgatgttatgaagaacgttaatgtagaccgcatagtgttaatgtctacctacctaactcctgcaaacactggttgtagatgggatatgaaactagtccttgataatgaacctgcaggtacaacagtagatgacaaaccttggttacctattgctaactacgtagacttagatgttaaccagttagctcgtgaggctaagcttagagcaacatttaaagctaaccaatacatctcaccaatgctatccttagacgacattatgttcgcagggtttttaacagcattgaaaggtagctatgtatctcgtacaatagacttaacagaggctccttacaacacggttaaaatgtcatatgaacaatttacacctgccggaactgttgtgactgctaaatacagtacagacgaaggtaaaacatggaagacatttacagtacagcctacaacaacacaacgtacacaagactttgttcgtgtagactatgttgaaaagattaatacgggtgggacatttaagtccattaaattccgtcttgatatgacgacccaaaactccttcctccgtccgagggtgcgccgtctaatgtgtaacatgacagataaatagacctaaactgtaaagtttaatgacattataacacacctttaatatgattgtaacctcctacgtgtataatatatttatacatttaggaggttttcatatgggaaaatttaaagatttaactggacaaacttttggaaagtggactgttgttgatatagacgagactaaagacagaatccactggtggtgtgagtgtgaatgcggaaaagaacagagcatacgagcatcttctctgacctcgggtaactccaaaggatgtcgagagtgtactagaaataatctgatgggtaagacttttggtaggttggcagttattaaagattcaggtgaacgagcaaagaacgggaatattctttgggaatgtgtgtgtgattgtgggaaaaaacgtttagtgttaggggctaatttactaaatggacaaacaaaaagttgtgggtgctactctacagatatacttaaaaaagtgtctactaagcatggactttctaaagtaaacgggaagaaaacaaaactttttatgacatgggatgcgatgagacagcgttgcaccaatagcaatcatgctagttacaaagattatggtggtcgaggtatcactgtatgtccggaatggctcaataacttcaaatctttttatgactggtctatggataatggattttctaatgacttgtctattgatagaattgacaatgacaaaggttactcaccagataactgtcgatgggtagatgctaaaacgcagattcgcaatagaagaaatacagttacttacaactggaaaggttcagaatacaccttagctgaactaggtgaactaacaggtattaacaagatgacaataaaatctcggttgaacagaggttgttccctcgaagaagctctttcacaaaatgtagatacctctgtgttacttatgacctataaaggggaaactaagcctatcaaacaatggtgtaaagaactgggattgaattatgcaactgtacgtaacagatattataagggttggactgatgaagaagccttaactggtaaacgcataaaatagcaacagaataagtataatagactctatatgttataatagacatatagagtctatttttttttgtttaggaggaataaaattgccagaaacacatagacaaacaagctcaggtgcacttatatttaaaccaactatagctgaacaagagcataaaaatgctatggaatctataaaacaagagagaacagagctagagaaagaactagctaatgttaaagctatcaaagatgagttgtcaaaagagctagcagatattaaacaactgaaagatgaattatcaaaatagtttctaaattgtcctatttaggatttctggttcccttatattattaactaatatatttaaataactctatataaaatatataatatataaataatatataataagactacgaaaaatataaaataggacaaatcaactctgtatacaccttgacaattacctactatgtgatataatgaatatattgattatactaaggtgggtatgtcaaggagcatgtatactaatctaacttaaaggagatttattaataaatgagactagtagtagatattatgcatactcagataaggtacgaagattcggaaaattatcttagaccagaaatccataaggtaatgcattcagaattaggtgttaaagcagatggataccaattcagccctgcgtataaagcgggttactgggatggtattattgatttttttgataaagaaaatgatacgttccccacagggttactacctcatgtagaaacaatactagggaaccttcaatcaactttatcaaagtcaggttacatttttcagtttgagataattgatgatagacctgatgagttcatgtcagtcgaggacatggataaggagatagtgcttaatggggataataatgacaagataacattaagggactatcaatatgaatctgtggagcaagttattaagaacagaataggtattgtaaacgttagtactggtggaggtaaaacagaaatagcatcagggcttatacaacaaataaccccttacctagagtcaggagaacgtattgcattttttacgaatagttcttctattttttcacagtcaattgaccgtattgagaaaagacttgggataaaggtaggtgcttttggtgcaggtaagaaagatattcagcaagtcacttttgtaatgatacctacgattgtatctgcaatatccgcagacccagaggctaaacttaagctgactgctaaagaaagaatgtacaagaaaattgctaaggatatagctccaaaatttgaaagagggtttaaccaaaggagtttgcttgaaggatacctaaataactttcaagttaagacaaaagcagacctgcagttgaaacatgaactagaagaaattttttattcatgtggtacgaacaaacaggttattatgaaaatgaaagggtatcaagcagaataccaaaagattgttgaaaagaaaaatggtaaagttcttaagaagtacaacgaggctatggagtttttagattccatatctgtaatgattgtggatgaggctcatcatacaagttcagatacttggtacaaagtgttaacatcttgcaataatgcccagtatagaatggcacttactggctcgattgaccgtacaaatcatgtgctttggcaaagacttcaagctatctttggggagattacaactaaggtatctaataatacgcttattgaattaggtcactcagctaaacctaaaataacaatattcccaattatagcccctgtagatattcaaactactacatatatggatgcttatcaaaaaggtatagtagataatgaatatagaaattctcttattgcaaagttgactaagaagatgtatgataaaggtaatgggattttaattataattaatcgcatagagcacggagaggctattagtgacttactaaaagaagagggagtagctcactactttattaatgggcaacttgaaaatgatttaagggatgaaaaaattcaggacatgcgtgatggagcacttaaagtaatgatttcttctacgattatagatgaaggtgtcgacatttcagggattgacacattaattcttggtgcaggaggtaagtccttaagacagacactacaacgtgttggtcggggtttacgtaagaaaaaaacaggagaaaacaaagtagaggtattcgatttttatgatttaacaaacaaacatttgaaaaaacattcagagcagagaagaaaaatatatgaagatgaacaatttgaaattgttgatattcctattcctaaataactataataaagaaagggtggcatacaattgcaaagtccatgcctaaatattgaattaaaagaaaaatttaaattaaacaaaggtataacagactttttagagagagttgcagataaatctcagagatggggtgaaacagtagcctcccctatccgtaaaacggatatggcaaaagagactggaaaaaaccctagaacaattacaagatatattaatcaattagaggaactaggtttaataaaaaccgaaacaaaaagaggaatgaatggagggactttagtcgtgtttaacacagatatgcttaattttgagccaaaggaaaaccctatcacgtctgatactaaacaagcaaaggagattagagaacaagtcttccctaaagccccaaccaaagtaccgaaacgcagatatagaacaaaagcggagatagctgaggcacgtatacttagtgaaaaacttaaaaaacgtgaagacattttaaatgataaaattgagtttaacgttgttactagaagttttttcgatagttttgacgaaccagaggtgtactttaaaggctatttaatttcaagaatgtataatgcttatgtgacaatcattccttatgaaaaatataatagactgaaaaatttagatgagaaaaaggctaaacaacaactacgagcatacgaaagctcttacaattacgatgtgttgcctagaagatttgttgggacacctcagtacaaaaaatttgtagagctagctaaatattgtgaagagaacaatatcaatcctttagtttatttaacagtgcaatttgatagaacagagtttttgatttctgtaggtaaagcacgagtaggggctacaccctatgtaaatactttgttatgtgcagaggctaaagaggcttacacaaatagaaaactgttctacagaatgttacagaaccaatatggattgtatacgtctatcaattcagaagctacttattatggtgcaacttacccaattatttcagggctattgaatgcttacaatatgccacagaaagacttgtcacagttagacactgctatttgtgacttagaatataaaaaagatattgacaaaaaagcaggtacgttgtactcttattatacagcaacacttaaatcgttagatgaatctaacgtatctagtgaagctaaagaaagtattgctaacttcttgaaagaacaagttgcaaacttttctagtaaacgtggactaacttcaacacagtatgccttagcattccctattcagataaactctgcacgcagtttattaatgaatgaggaagacgaagaactactttatttattgttaggtaaccagtcacgattatctaatgtaacaaatgatgaagctgaaatgtttattaaacaaggtagaaaattaagtatgtcttggtggggctcacagaacttctcaagaacaatgttcatgttagcggactactatgggtttaaaacaaatatatctaagttaggtatgtacattaaagaatttggtgaggagaaaattcctttagattctgtaggtatgttagatgtaaatagaatctatgatgtcttaatgactgaacaagagattttagagattgacaaaagtaactgggagaaccaaaaagatatgcgtgacgacaaataagaaatataaatgggagagggacggatagtaagatgagtcaaattcaaaaacaagttatttacagagcattaagtgagccattctttgcaaaggaaattttaagtaaaattccaatggatgagtttaaagattctggatatgagatgattgtttctacaatcaacttatattacagaacacatgatgagagcttagaggaacagagtttattaacactagtagaagataagatgttaaaacaaaacaaaagtttggaagctcaaaacaaagtctttgaggtagttagcgacttatacgaactagagaacgaagatgtagactcagaagttatcagtgagaacattcagaactacgttcgtaaggtactaacacgagaagcaatcatgaaatctgtaacaaatgaaggcacactaggctctgatagtaatattcaacagctaatggatgacttgagagacattcttactattgagacagcaggcaataattcagaattgctagacttcttcgatgacgtagataaaaagatggagttacttgcaaacttacaacaaaacaaatacccaactggtttcacagctattgatgctatttccgatggtgggctagctcgtggagaagtcgggatggttgttgcgcctactggtggtggtaaaactacttgggcagttaaccaagctagaaactatgttgtacgtggtttaaatgttctttatgttcctttagaggaaaaagtagaccgtatgattgttcgttttgaacaattattatcacaacaaagtaagaagaacatcttagttgatggtgaattgaataaagacttgtatacccaaatccaacaagcgtatggagcgggtaaagaacagatgaattggggtaacctttggattcgtaaatataaaccacaagagctaacacctagcggtttatctcagttaatctccgatgtaatgattcgtaaaggacagcaaattgatgttgtcattattgactacccagatttaatgaaaaatcctcatgcaagtggaagtaatggtgaatcagatgcaggaggtaaactatatgaagatattcgtgcgattgcacaagagtatgattttgtttgttggacgttatctcagttgaaccgagcaagctatggtcaagatattaaaaatgcaggagctatcgaaggttctaaacgtaaaatgaacgcagtagaacttatttttacattaaaccaaacatcagaggagtttagtaacggatatttgagagcttacgtagataagttacgtaataatagtgggattgcctatgataaaatgttgtattttaaagtactcccagaaactatgactattagagatgaaacaccagaagaacgagcagaacatgaagcactgttagcagataatgcgatgaatagagcaagtagccactctgatgagaataactacacagcaaacgatgttaataaaaagataagtaatttgaataataccctttcaggaggttggaattaatgaaacatattattaatttttcagattttcatatgcacttttttaaagatttttcaaaaccagacccagagtacggaactgatagagcaaaagagcaaattactatattagacaacttgatgaactatgcacgaaacaaaaatggggatgttttatttaatggagacatgttccataaacgagtatctattgatgttagaatattcaatatgttatttcaagtaattagtagctaccctgatgttgatgttatcatggtcagtggtaatcatgataaggtaactaactctctatactcagatagtgctttagcaccatttagtgctttaccaaatgttacagtttgttctacgttaaacaagattgttaaagatgattatacgttgtatgctgttagttatggggaagaggtcgaagagatgaaagcttggataaaagaacaagctgacaatttagaccatgaaacagttaatattctaagtgcacacattggtgtagatggttcatctactggaaagtattctcatacacttggtggtgcttttaaagtagctgatttataccctgacaagtttgacatagttacattgggtcactatcataaacgacaatttttaggaaacctatctaacgtgttttatgtgggcaataccctacagacttcttttgcggacgaaggtcaagaaaaaggtttttatgatattactatagagggtaagaagtgggaacaaaaatttattaaaactgactatactccgtttgaaacagtaacagccgatagcccatcaacaacaggttctatggagaaatcttatatccagtttattggtaatgtggacgaggttgaggctgtaaagagaataaaagaagagaataacttaagcaatattagaataaaagttcagaaggactaccatgttgagccacgtataaacataacagcaggttcgacacctaatgaagttgtcaatgcatttattagtaaaaagtaccctaacgcaaaaataattaaagaaaaagctctcgactgtttgagagaagcaatggaagtataataattgtttagcctagatatatctaggcttttttgcgttgtactattgactttattagtattttgaagtataatatgtttattgaaataattaattaatattttgggaggaaaagatgttaaagtttaaacgagttagcgcagagaactatatgtccattggctctgtatctattgatttagacaaccaaggactcgtacttatcgaaggtataaatgatacaaacgaaacatttcagagtaacggctcaggtaaaagtactttactgtctaccgttacttatgcattgtatggagctacccctagtggtttgaaagctgatgctgtaattaataaacaagcaaagaaaaatatgtcagtgattttagaatttgaaaaagatggggtaccatatcgtatcgaacgttatcgtaaacactctaaacataaaaatactactagattttttcaaggaacaaatgatataactcagaaatctgtagcagacactgacaaaaagattcaagatgtgtttggcattgactatctgacttatgctaatagtatcatgtatggtcagggtaatgtagaaatatttgctacagcaactgataaaggtaaaaaacaaatcttagagaatttagccgatattggtgtttaccggtatgcacaggatgttgctaaagaaagagcgcaaaaagcactagctcttgcagaagagctgaacaggcagtacattgctaaggtatatgaaaaagatgggttaactcaatcttacaatagtgctttacaacaatacgagaatacagaaaagctgattcaacaaaaagagagtgagttagctaatgcagaattagtcattaaacaaagtgagaagaatttatcagagggaagagcactacgtgaacccgaattagaaaagctaagagagcagatggcacaattaacttcccctgcagacgttcgtgaaattgatgtagaagtcgaaacacagtattctaatgttagcagattgtctagtgcaaaaacacagaatgatactgctatcgagaaattaaaaaaagaactagaagatgttaaaacaaatacaaattgctacctatgcggtgctttattgagtccacagcatagagaacaagaaattcaacgtattcaaagagaaatagcggataaagaagtgtttgttgaaaagcttaatagtgcattagaagtgtatacccctctgttagagcaagcaagagccaaacaagaggaagcaagacaggctattcaagaacatactaatatttatcataaacttaatggtgaaatgaatgcgttgtatcatgagatagatacattagaaaacacattgaacacatctattaataatagggacagcattaaggatatgttaacaagactacaagaaatacctaaacctcaatatgactatgacaaagaccgggaaatagaagatgaactaaataacattaatcaattaaagttagatgccgaagaagaagctagtcaatataaaactattgcacaagagattttctctaataaaggcatacgctctgaggtactcgacctagttacacctttcttaaatgaaagagcaaatcattacttatctaccctttcaggttcagatattgaaataaactttagtacccaaacagagaaagcagatggtagtttagctgataagtttgacctagaggtagtgaatggctctggtggaaacacatatcaagcaaactccgaaggggagaagaagagaattgatttagcaatatcttttgctattcaagatttagttcagtcaaaagcaaacattgctgttaatttaggtttgtatgatgagtgttttgatggtttagatgcaattggttgtgagaacgttattaaaatattgaaagaacgccaaaagaacattagtagtattttcgtaataactcactcggagaacttgaagccattgtttgagaacgtaatcactatgaaaaaagttcaaggtcgttcttaccttgaagaaagtaaataggtgattacatgaagatttatacattaagtagagaattaaacgaaggtactatatttgtacctacaagtagtagtaatgaagggaaactattcagcttcccgttagggacactattcgattggtacccttgttgcccaagatatgagtatcagtatagcacttctcgaaaaaaactatatttgagattgttagactcagacaaaacattagtagctagatacggtgttggggataataaaaagagagttatttcaaaaatagcttgctttaatgagaatgaatggtataatgaagaagtggcaaatgagaatgcagagttgtttaactttgctgaacaatatgacattgttacacctttaaaagacgattatacattaaaagaagtagatgatagtatttctaaagtactggatattcttgatttactttatacaaaccaaaaagttaaagtagaggaagagctcataaataaagtagatactctacaattgagcaagccagactcagatgaacttaaacaagcgtataaggacatatctgagtatatgcggttagacagagaggaaaaggctacttatgtgttaagcaggtcactagactctttaaatagtgtttatgaaaaatttggtaatgtgtatacaatgttaaatattatgaggaaagtagtggcttaaatgtttacagacttgttatctaacgaattaggttcacctaaatatgcagtaagggactacaggtacaattgtcctttttgcgactacgatactaagtataagttttatgttagggtagaagaaggacacccaaagaataacttatggcattgttttaagtgcggtagttcaggtaacccagtatcttttgtaatgaagtattacaacgtgtcttttaaagaagcgctagagatattagaagaatatggctataggtttaataataaaaattatgtgcctaaatcagataagttaactgatgaggaatacttattacttcttctaggttcgttaggtaagccaaaagaagaaactaaacaagctaaaaaagagttagtcgcacccccattgccagatggttttaaactactaagccagaacctgagagagccagaagcataccctttcttattatactgtaataagaggggatttacattgaatgatatttacatacacaatattgggtatgtaaaggattcttgggtaccattagaaaatggtaagtcagtcagacttaaagaccacttagtttttttaactcatggaaaagatggcaagtatcaatattggaatactagagctattgggcaaagttttattaagtctttgaacgctccaagtaaagagggtgagcattcaaaaaaggacactatatttaatattaatagagctagtcaaacccctcagatagttataacagaaggtgttcctgatgcattaacagttggtgagtctggggtaggtacttttggtaagcaggtgactgacgagcaagttgaacttattttagatagtgtgaatgaagagcaaaaaatatttatctatttagataaagatgctaaaaaagaaattaagaagttagcagagaaactatataagagacataacgagacttatgtagttataagcccaacaactcaagatgcaaatagtctagggagagaagaggcttggaatattataaataactactctgtaaaagcagatggagtagggttaataaaattaatgttatagataggagagggaaaaaatgagatatacactagaagatttacatgcaggtatgaaattacgttgcacggacagtaaaaactacagtttttggactacgaataaaatctatgaagtaactaaaaaagagtcaggttcactatgtatttttgatgattatggaattgagagcctagatgaggacatcttagtacgtttaaatggtaatacagggaacgcagaatttgaggttgtttctaaggtgatgaaggatgcagattacacagaagaagaccttgaagaagggatgttacttcactgcaaagatggtatgagctttccatggtgggctacaggacaaacctatgaaatctataagggtgaaaaaggaattttatttaccaagtcaggagacggtaaccaatactgtgctaaagaaatagtagctcgattaaatggtagtgcaagcgggtcttttgaattactagaaagaccacataaaacagagttagaaaagaaagtagaagcaagaattaaggaattaaaagaaaagaaactttgtttattctacaagcaacaacaaattaagatagaagaaaacgaaatatctatagaaatcagtaagctaagtgaagcattaaaagcgattgacgtattaagagaatttgaataagaataactataggaggctaacaaggatgggaagagtatcagtatattttctaaatagcagaaatattatggatgaggatgagacaaagcgtacttatcatggaacatttaactcgatgaaagaagcagagcagtcagttcgtgactggtggaaagcaaatgactttaagtgtggtacccttagaattattgaaggtactgaggatgggattgttcgttgggactacggaaaccatactgggttctatctatttgtaccagaaggtgctgtagtaaaatacacaatccgtgaaggcgctaagaaaccaaaacgaggaagagaaaatgatgtagcacatgacttattcacagcagacgatggagtagttattcccgggagattaggttcaaatgttatttctactggaataaaaacatcgtttgaccccaaacaatatggtttattcattaaccctcgaggtggtatgatgaaatacccaatcactttaggaaacacacaaggtgtagtggaaggagaatatcgtggagaggttggtttaccacttaaaaatacgttctctttacaattagatgcaagagctgtttctaagaacgttttaacaatcaatgaagaaggtaaacttattaacatcccagtaacagtagctcggtcaatgtatccaagctttaatgctctttatgaaaaacagctagagaagctaagtgaggagctacagctagtttatggaggagaagttagaatatctaatgctgatgagtatgtggttgcgggaacactatttatcccaaaaggcactcgtttatgtcaagctttcttactaccacgatacgacacacagtttgttgaagtatcagcgttaggtacaactgaacgaggagaaggcgcatatggctcatctggggtggtatagttatgctcatcccagaatttaaaccaccattattgtacgttatgggtagcttttctgttatgttagaaaaacaccagtgcagtgtaactttttatttaagagagccttatttaggtacctcttacgataaaatagtgaagcttattaaaatgacttacccaaactatagcttaacttatgtagggatggcagacaataaatataagttcacattaaagaataaggaggactagcatgtacaccaagaaagaagaagtagtaacagttaaacacctagttgataaagagcaaattagagtaggggacatagtaggttacaaaaagactattagagggttcgatgcaaaaagagtaaaagacacactctcagtaacaaatcaaataggtgtagtttctcgtgtatgtgacgagtatattactgttcatgacttttttgataagtgctcacgagaaatatgggcaaagacatttgaaaatttagaagttcgcaaaatagaggatggtaacagtctactacggaggtatgaaaatgaatttcgttgattattttaatcagatgcagaatttagtgattgaagaaaaaacagatgagtatgttttattagagaaagaacatggtcaaaagtatgtgacatatcaagagctagaaggagcgttaagtacagtagcacgcaacactgcatttatggtagaaaattataaccttatgcaagatattaatttaaaaattgtattgaaaaaattaaaagacagtggtacaattacagaagagcttgaaaaagagattcttaaagagttcaaaaatattgaaagtttaatggaggacgaaacatatgagtaaagagagtaaacgcaacaaacgtatcggggaattatcggaagcagacatgagagtgtgggctgagtggttagctacggggcaggttcatgataaaaaccaccaaaaacagttagaacgcttaagtaaacgttcagtatcattatccgatgtaactacgattgtcgaatttatgggcaaacggaatgatggttatatttcttctttaattgaacagcaggctgtatttgacaatttattaacaaaactaggtgtaacggaagagaaccgcttagaggctaaagcagagtacgaaaaagagttaagccttattcaagaaaaaatccaaaaagagttagagtctattaaagaaaataaagaaaaataatatgaaagaggttagctgaatgacagactacagcgcagtaggcaagaaaagtcgtaacaaaggcggacgttttgaacgtcaaatggctaaagaactcacagagtggtggggatatgagtttaaccgagtacctgcttctggggggcttcactgggcttctagtaataacgttgccggggacattgtagtccctagcgatgctaacttcccatttgttatagaatgtaaaaatcgtgaatactggacgattgaaaacttattcttaaataacaaagaaattaagaactggtgggcacaagttgtgggggatgcaaaagaaacgaaaaatatcccactacttatatttactagaaacagagcaaagaattttgttactatggcatataatgaaaaacttgttaatgagattgaaaaaagaggttaccctttgatggtctctaacataacatatgtagacgactacaaggatactcattgttacaagacatttactacagttttagatgcaataactagctttaagccttatggtagcaaagacaaagactactttttattttattttcctagtgactataactgggaagatagtctagtttatgaaacaaccataatggatgatgctaaacaaatggatgcagaggattcactagatgcactagttaattcttatttaggaggagaatagtatggctaaaacatatcaggaagctctagcaacagtacagtcgtatctcgaatcagatagtgtaatgaaagaaacctcaagtatatctgttagtttctcagctaactggacaggtgagcgggaagactacgttattgatacattgacatacgacattgatttacgagtattcagcttagaaactgcacatgttgtagctatagggaagaaactacctcaagatagcaatgagcatgctgaactccttaaaagacttaaaaaagaatttaaacaagcttctaaaaaactacgggaggactagagtagatgatagacaacgttaatagccctagtcattatacgcaaggagaaatagaggtaatagaggttatagaatatattactgctaagtaccctgcggaaattagataccatttaggaaatgttattaagtatatttgtcgagcacctttcaaggggaagctacaagaagaccttaacaaaagttcttggtacttgaaacgagcacaactggttttaacatggtcaccaagtagctatacaggtaaatgtaagaaatttttagagaatttcctatttaagaatagccatatcagagatgctcagctaatagaaataccagaggaacctattattgagaaatttttatttcaaacagcacagagttacaataaagaacagcaaaactatattatttcagccttaatggaactaaacagtagttcaggtgatgtgaaaactgttcttgaaaatacagaaaactatttaaaatttattacaacttagtacaatataatgctctttctacgaaaagctatcttttatatttatggtataatagagatagggaaattaaaaagtagaaggagcattttataatgacaaaagcacccagagtgaaaagacttaatatttataacactgaccggtactttaatattaatttaatgaaaaaagaagatatagcaaaaaaaattaaagttaaccgattgaatgaagaagagatagagagggaaatggacgaactagcaagtaacccattgaagacccctataggctacatggatagaacaaatgaaaaatcttatatactttatcaagaaaagtatacgaacgacagacttattcagaaattatttaaacatgcggggtctgtgtcttattacacagatacaattgtaccatactacataattgagcaaatatctaagaatttaacaagtgaagtaatctatcctacaaaaaatagctatgagaacagagagattgaaaatgttcaactagctttcactgcttgccctgtaacgattgactgcccagtagtactacctgatgttagcccgtatgatgtgttatttgcactacatcctctaaaaacaaatgtagacaagattcaaatatcgttcccttgtcttacagaagaagagttcgatactagacatgaagaatactatcataaagtaggtagccactatgaggttaaatcagagtacaaatataaattctttaagtatgtacaaacttccttatctatttgggctatgaacatttggctagtgtgtgatagtgatgaggactacaataaaatagacagatatattcagaaggaaaaaattaaacgtaatgctaacagagagcgtgcattaaagagaaagggtaatcaggatgagtaaagataaaacgattaaccgaacagacatagctcgaacaatctctcaccatactggttatcgaatgaaagatatattgaagattttagaagtagaagatgaagtagtagctcaagcagtatcacaaggtatttctgtaaagaatcacaaattatggaaactaaacattaaaaaaaagccagagaaggtagcatgggatggtataaactctaaaagttttatacaacctgagaaatatgtagttaaatttgtaccattatctaagttgaaagagtcaatagacacttataataaagagagcaaataaagctctcttttttgctctttctatattgacaaataacataatacaaagtatactagtgtcatagagcaacagagaggagaaaagtgtaattgaaaattctattcttacaagagtatattagagaaaatcatgtccataatggaaagaacggacaaacagttgattttaaaagaacagaaatgggtaaaaaactcacgggtctgttaaatacaatagggctgacaggtagggactatgctgtagactatgtgtacgacatgattccggaagtacagaaagttaaccctagaacaggtaaaccaattaagtataagacacctacgttaagacagcgtaaagaaccagaggaacggttactcagacgtttaatgaaatacaaaccagatattatcatcccaatgggggagatgggttgtaaaaatttattaggaagtacttctatcacaaagaatagaggagtaccaactaagaaaacaattacgaatgagaacatactgagaacggctgatgagcaaggacttgaggtagacgaagtagtagactcttttgaaacttgggtactacctatgtttagtatggaatactggacagctaacccaaacattgagaactttatcatggcggatattgatacattgggtaagtttgttcaagaaggggaacaagcatttatccctaaaaaagtagattacgaatttgttgataacattgaacgtgtaagacaaatttttggttttttagacaaaacgaagccagtaactgcatgggacttggagacaaatagtttacgtggtgacttattaggggctaagcctcttgtaatgtctatgagttggctagaggggcaaggtgtgactataccgttagaacaccatgaagctaaatggagcccagaagaacttaacgaaatatatgacttatttgagaagtttttagcggacagacagcaaccaaaagtaggacaaaatatccagttcgatattagattcttaatgaacacaaaaggatttacagagtttgaagacaacagagatacaaaaattgcttactatctaattgtttctcagaaagtagacacttcaaaacgactatccgatattgcatatgaattaacagatatgggaggctatgacgaaccgttagagcagtataaaaaacagtataaagaggactatattgctcgtaagaaagcagagattgatgctttcaaagaagctgaaaaagaacgagtagagggtgagttcaagatagcaatggatagatataagcaagaagttaaagaagctaagcttattggtaaacctactaagtccattattaaaccagtaaaagaaaaagttgtagtacctaagaaatcggatattaaacttattaatgagattgacggtggtaactttaactacgactggattccattagaaattatgcacccatatgctagtggagatgtcgattgctgtctacgtatttataatgttctatataaacgaattgaggaacatcctaagatgttggaattatggttgggcttttatcctagactaacagcaacattagcacacatcgaggcttctggtgttctattagactctgaatacgcagaattagtagagaatatctatacagaagaagaacatcggttgcttaatgaaattagaaagctaccagaagtaaaagaagtagaggatgaacatatgatgttctacaaagaggggcttaaagaaatgacaaagcctgtcaaagatagagatgcctctgttgccagactacgagataaatataaaattactgatagtgagaacaaagtacattttaaaccaagttcgtctgaacataaaggtagactgctatttaaagtaatgggacttacactaccttatgataaagaatctattaaaaaagaaacttttgacaatggggtaccagaacatcagctaacatggagagattataaaacagataaacatgcactagcttatattgcagaaaattatccagaggctaaacatgttgctgaacttttgctagagtattctaaagtaaacacactaaaaaataactttgctcaaaagttacctaaattagcatctaacaaagatggcatgattcatggttcatataacagtacaggtacagaatctacacgattgagtgcaaacaacccgaatatgcaacaattaagtagtaaggttggagaccctagacgttttgactataaatatccaattaaacgtttatttagaacaagatttgagggaggcggaatgctacaactagattactccgccctagaaatgcgtattttaggtttgattgcaaaagataaagcaatgacacaagcatttattaatggtgaagatatgcatgaggcaactgcatctcttgtatggaagttacctaaagataatgtaccaaaagatatgcgacaacgtgcgaagagtgtcaacttcggtattgcatatggtgaaagtcctttttcaattgcacctaagttaggtgtaactgtagaagaagcagagcgtatttttgaagagtactttgcaagtaagccaagtattaaacaatttattgaagagacacatcaatttgctcaacgttatggctacgtagaaacactacaaggacatcgtagactattgcgtgactcattctctaaagataagaaagtatttaatggagcaatgcgtaagtcagtaaatacaatcattcaaggaactggtgcctacttaactaacctatcaatggtatacattgacgagtatatcagaaaacacaataagcgttcacgtattgttatcactgtacatgactcacttgttatcgattgcccacgtgatgaagtggacgagatggcaaaagtggctaaatatattatggagaacttgccaattgatttcttaatgattgagtgggaaggtaaagagatgcgttaccctattgtggcagatgtagagattggggagaattacaatgatatggttgattatgatgcagaaattatcaacgagtttgcttcttaccgaggatacgtaaaatacttcaaagaccaagctaagattaaagattactatgataacaaacttatctcagaagagcaaaaagaccaaggtatcaaagttatccaagatgcaatagagtcatataaacaaatgacaatttaataaaaaaatgttaaaaatagcttgactattgacgtatagtatgttattataatatggcagacaagttttctgtattaatacaagaagggggagttagagagtgtgcttaatttacgagtagacgatttagagttcaaaacaattaaaattattgatgacaacggagaagttgtgacacatgatttacaaacagagttacaagtcaatgaatttaatgtgagaacagcatttttagagcaacctgctaagtatacttattggacttcgatactagagcgcttgcgcatgtatcaagaaaactatgagttaaaagcagagaagaagaaagcagaactatatgagccttctcgggttgccttaatcaatcaaggagtagctaaacctacaaaagaccagattgaggcacagattatgttagatgaagactactacaaacttagacagagtatagttaacctatcatttaacgtgagacaactgcaatatatagttaaagcttttgaacaaagaaaagatatgcttattcagtatggagcagaccttcgtagggaatatgagtatagccaaaaggttagtatgccagacccaatgaaaaataaggtaaataatggtttctcagactttcaatggaatttagaacagtaaaattagtgataaaaaaataatataatataaaaaaaatagaaatggagaaatttaaatgaattttcaagaacaattacaacaacaattaaaacaacaaaatattggagaacgtgaagcggtagactacccatcaaatcatttaaaacataaagaattatacttccctaaagcagaaaatggtcaaccatcaactctatatgtacgtgtgttacctcctgcagtaccgggagaaaactataatgttagcgctcgtgaggcattcttaacaactcgtaatcgtaatggtaaagatttaaagagcaactttatcttttcagaacaccctaatgcagaagacatcttagaacaagctatgattcgttggaacgcagaaaatcgtgtaccaaacccttatagccgtaatacaaaacctcgtcaacgttactacgttaatgtagtgcagttaattattaaccaacaaacaggggaagttaactacgaaacagattctaatggtcagctaatggttcgtttacttaagttaccacaaacagcttgcatggctattaatgagagcttaagtaacccaatgttacgcccacagttttcacctgatgtaccagaagaagtagcacaatacagctttatttcttctgcagatgcattccctatttcaattacaaaaccaccacgtagtaacaaacctacttcgtacaatgtacaagtgattagtaatcgtagtttaggtgcattaccacaaggttgggaaaacttattagaagacttgaaataccaagctacaccttctgtagagtacaatcgtgaatttattgagtactttattgatgtagtagatgggaaggaacctattcatcaaggagctcaaagtcaaggaacccaagctccacaatttaatcagcaaccagtacagcctcaatttaatcaacagcctgtacaaccacaatttaaccaacaacctgtacaaccaatgcaacaaaatactggttggtcgccacagcaaagccaaccacaacagcctgctacaggttttaatgcaacgaacatgggaacacctccaaacattaatggagggtttaaccaacaacctgtacaacaacctgtacaacagcaacaaccgatgggctctttcaatgaacaaccagtgacagacccttctaccatttctgatgcggatatgcctttcaatatgcagtccatgcctgatgtatcaccacaacaaaatgctgtacctgagcaacctgtgactaatacaccagagccagtaagccaaccagttgttaaccaacagccaaataacacacctagtgtagacgacctattagcaggtatggtaggcaacgtttaacaataatgaaacagttaggaggggcatactgccccttttaattctgtgttaactatccaaaatatttagtaggagtgaataatattggcaagaaaaagaaaaagtgaagaaatagattttggaactattgatttgacaaaagaggtaggactaactacatttacggacacaaagttctctaatgtatcagacagactaccaacaatgattccacagcttgattacattttaggtggaggattgccatttggacgtatggtcgaggtctttggtaagaactctagtggtaagtccactttagcagtccatctgacaaaggtagcgcaaatgctagatgtaccaactgtatggattgacgttgaaggtactgcagacccagaacgcttagcagaactaggggtagactttagtgcaggcggagtattcatggtagagcctaaacagaacaaagacggtagtaaagatacaatcacggtagaacgtgtagcagaagagttacaacgactcttaccagtatttagtaagcttggaaaacctgtattaattatttgggactctgtagcgcaaacagcttctgagaaagagttagaaaaaggtgtaggtaaccaacagcccggaattaaggcaaaagcaatggcacagtttgctcaaatcattgcacctttaatgacaaattcaaaagcattatttattgctattaaccaagcacgtgacgagctaggcagtatgtttggtggagtagactctcccggaggacacgctttacaccactgggctagcttacgattagaagtagttaaagcaagtcagattaagaataaagagctaaatgcattcggtgcagaggaagagacctatgtaggacatatcctgcgtgttaaaacagcaaaatcaaaagtgtcccgtcctaaccaaaaagcagaaatgtacttaatgtcagacacaggtctgaacttagaggaaaacatttatcgttcatgttttgcaactaataagcagtatgccttgattagtggaggcacgtggaagtcttatacaacggatgcagggcaagagattaaatttaattcagataaagcttgggtagcttatttacgttcagaagagggaagacctgttcgagacgaactatttgctaaaatgatggtacgctcattcccacatcgttatgctccatttaataatgaggacgtggatgtatgcaaaattccattatatgaatttactaaagaatatatggaaaatcataaggaacaacctaaccaagctactaaagaagaagtccccgaaacaggaacagatgtttcagatttacttaaacaggtagactaatagataagggggcatttagcccctttattagctataaaggagaggaacttattttgcgcaaaggactagcacctaacccattttttgaaatattagaaaaacatcaagactcctctaaacgtactatgactatgaacagcagtggtacacctagttcactacaaccaataagagacatgttcttaaaggcaatgagagaaggtaagagagtcctaatagagaactctgacttaagtagtgcgaactctgttgttatagagatagaatatgtaggtaatcgttggtgtttaggttatcaacgagtcttattttatggtatggagttaaaaataccacacactatccacttctgcgatgtatatggagcctatgggcacgatgctcagaaggttaagagacaagttaaggtagtgtttgagggggacaacccttttgagtagagatgttcaaaaagaggaaaaagaaatacgtaatggtaatcggtttattacagagactcatggcaaaggagtgtttcctagagatgtagaccgattgtaccataagtatagtaatcttagatataaagtctataacactcataaagactcgttcaatagtgaggcttcacgtaaggagctcaagagctatattgatgagcaatttataaagttaacaaaagagtatgatataaatggagaggtagattttccgggatatattaaaaaagctctgaatttacgagtaaggcacagctatgtaaaaggacggttccgagataccgctagagaacgtctaggcacccaagataatgaagtagagttattgttagggattgacgatagctctcaggcagatattgaggatgcagaacttattgaatcgttattatcaaaagccaatttttcagaaattgaattagcagtatttcagcagttaattcaaggaacagtaagggatgctcgtattattactgaattgtcagaaaactatggggtgtctaaaaaagccgtaaaagatgctataaaaaatgttcgtgagtttgtcttaataaatttaacagattagagtaatacctcctttatgtctgctatattagcagtagaaacataaaggaggtattttttagtggaacaaaacaacactggcaagtatgcaccatttattcgtttaattgtgatgggaatctcatttgtggcaactggtttgactacaatatttggttgggaacctttaccattcacagacgaacaaatgaaccaaggtttaatgttagtactatctgtaggtcttgccatctacaactggtacaaaaacaacgctgtaacttcttatggtaaagcaaaagaagaagcaggaaaagaagtagtcggaactagacaagacttcaaaaacagagactaagtacgaggggtgtaacccctccttagttaatacaaaggagcttcgacatgaagatagacgagataagcaaattagaattgcctaatctatttggaaaattccttgtggtagagactatttcggatgggtacactggaaccgtatctggtcactataactacgagatagaccaaaaatctgaggaaacttatatttaccctgtattttggaatgataagcttaacaaatttattaggtcagatgaattagttgtatacactaataaaaataaagtatactatgtttgtaaaacaactatagacccatataatcatgcagtagtagatgagctcacagtagaggaaggcatggacaaagacaagcgtacccttcaagcgtttaaactttttgtaaatgacctattctcatttggtagctacaatatctttctaacaggtaacctatcattagaaaacaaccctgatattgttctagttagcagtgtatcattagacaaacagaccgctaaaatgtacacagaacggacattagaactaactgctacggttttaccagagggagctacaaacaaaaaagttattttttcagtagataaaccagagcttttagggttaacagtctctgacaataaagcaactgtcacaagtaaagataaggcaggtactgcaattgttaccgtaactactgaggatggagaacacactgataagtgtacagttcagatagaagagtacataaaagttacaggaattaatgttagtggagaatctgctttagaaaaaggtaagacatacaaatttactgctagtattgtacctgataatgcaacgaatcctaaatttacttggtcttctagtagtgataccatagctagtgttaatgcaagcggtgacgttgtagctttagcattaggtgaagcagacattatagcaacaactgaggaaggtagccatgtaggtaaagtacatgttaccgtatcagacccagaaccagtagaaccaactgaataatatagaaaagaggaaagaaaatggctaaagaaatattaaatattgaagacctattaaaaccagagacattagaagtagcgatagatggtaaataccttattgtaccaacattgtcagatgggtttacaggtacagtagcaggcggatatgcatatgctgttacaaaaaaaggaacagactacacagttaatgaattaatctataatcaaaaggataacacatttaaaccttctgatgaaccaattattataactgatgataatgaaatattcttcattactcgtacattagaagacccatataactaccctgtagttgctacagagaaacttaaaactaaagatgtaaaagaaaaacaagttttacaagcgttcttagcatttgctgatgacagatttaagctaggtgtttacaatgtgttcctagcagatgaaccatttgtatatggggacaaaacagaatagtttcattataagagacccgttaaggtctctttttttttgtatatagtgttgacaatgttgtagtttagttatatactatacttatactgtataaggaggtaaccacatgaacgacaataaggaaaaatgtgttaaacaagaaatacgagatacttataaagggtacgatattttattagatgaagagaatgggtttttctatgttagcgtacttgacccagatggcaaagaaatcattagtgggtttgtagaggcggataaacctattgaagaatactataaagagctcctaggtaaatgcgaccaagatatatcgtttaaagaccttttagggttcttaaatggacgtagagacactgaacgtacagacatacgttttttaaagagagacagtggggtataattaaatgacaaagataaaacttattacaaaaaagaacacccaaggctatgtcatgaacaccctgctacgtagattttataaaaataatgtagacgtagaatttcttaataaattcaatctacctgatattcataaccacataggggagtatgatgctgttatcatagtagggtttcctttctttgaaagccaacgaggtgcgttagacacggcactgtcatctatggacaacccgtttagcaaggtgtaccatttagcaacatttggggacacctatcgtaatgaaggtagctttcgttcatttgtagacgaggttataagccccgttggtcattttgtagaactaataattgacctaactaagttcactaacacaggtacaaaagaggatgaacaaaatgtagtggctcttgctaaagaggcattagtgtttgccaaagatattatagaagagacagacaactacaatcgttatgaagttacagacagaactatctcttgggttcttcttgtagatttgcttggagagaacctatataaggtgacagagcctagtaaagagctagacaccattctgaaagaacaagaagtactcgtagatgccttgaatataaatatgcaggactatgtgctaagaacaatagggaagatgtctgcaaacgtcattaatggaacagtggtttgtttcggttatgcagaacagcatgttaacgaagtagcccataaattaattaatttttataagtcacataactatcaaaaagttattgtctttattggtagacacacaaaaggtgacgacatgtttagtgtaaggagctatggtgtgaatgccggagaggttgcctataaagttcataatggtaaagggaaagacacaacggcaaccgtcttcttaggtaaacctagtgaagctgtaaataacacactgttaagtgtgctttctgaaatcttatagtttaactttgtggtataataaagatagataaattttgataggagtgtaaatttttgaaaaacaacgaacctttagagaagttattagacaaattagatgaaccaagaattttacaaacaattattataggtagtttacaacggagctttaatcgagtacacgttggtaaatttaataaactagcacaggagtttgacttagataaggagaacctgtatagcttaaaggcactagttaaggaaattgaagaagataaagagttacacgaactttacgaagctagcatggcaggcaaaattacgctagaggctgttcgtaaagtattgttacaagatgataaatcatcgtttgatgtactatcttcttacgtagtagaaaatcaagcagtgctagctcgtaaccgagagttcggtaagttacaacgtgagggtgcttatcttgaccatctaattagcggtttgaagacatacttattagctgaactaaaagacatgtctagtttaaaatatatcaataaaaatttaaaggcaccgaaagtatcctcagaccgagaacttattctgtgcctatctgattggcatattggtgcttttgttaataacattgacacaggtggatacaactttgaaatctttaaagaacgacttgaaaagttattagaagaagtattccaagtggctatggagcaggatattaagaaaattcatgtttaccatattggagatattattgaacacattaatatgcgtaatgttaaccaagcatttgaagcagagtttcctgctacggagcagattgctaaaggaattagagttcttgctgatacactcaatttactagctaaggcagaatttgaagtgtctttcggtatggttggtggtaaccacgaccgtttccaaggtaacaagaatgataaaattcataatgataatgtggcttatcttgtagtagaccaacttcatttcttacaagaattaggggcattaaacaaagatattaaacttgtagacaacagaagtgacgtttatagttttaaagatacagttgcaggtaaacgtattaaagtaactcatggtgacactgagggcaaaaaagtggatgttaaaatccctaaacatatcaaagatgaagttattgactatttaatcatgggacatatccatacaacacgtattattcaagaagacttttcaagattccatgtgtatgttggctctcctatgggggcaaacaactactcagcagagaataacttgccaacaacaagccctgcacagctaattatggtattagaccctgagcgtgatacaccacaattcatgccagtattcttataggaggtactcgtatgggaggtaatttagtttatattttattggctattgcatacgtaggtgaaggtataactgcctttactaatactaagcgtaaagaaagatacatgattgaagaaggagaggctcctttgccacgtagttcttatgtatttttaggcattaactaccttttaagaatagctatagcaatttctcttatcttcatcataccaactagcttgcaacttaacgtaacaggtattgctttgttcacactaatggtatttgtagttccttttatagcaagaattatcgaagttgttattagaactgcaattgttcgttatgttcaaaaacaatatattaagcagttagaagaacgaaaaggtaaaagagagactaactagtctcttttttgctatattgaataatgaggtgactaagtatgaattttacagaagtaataagccctaatggggagacatcattaatagatgtaaacaacccaccaacattaatcagacgtggggtcttatctattaaaacaaaggttaataatgaagtgaaggaaacccctgtttatattgttgaactagctgaggagctaacaggtactgatgtagtgtctgtctataaagtaaaagagattggagactctatccaaaaagattacattgaagaaaaagtgacccctagattcaaaagcacaacatatctgggtgagctagcacaaaagattaaaggacggtcgataaaggagcaacgaagagttgaaacaaaaccaccattattcctagccccagtagttaatggaatcgatacattcacaggaattgaaggtaagggtttctacgaacgtgaagaagacaggcatattctactacctgatggaaaaccgggaatagcctatggagataatacaggggtttttatcggtttgagctcgattaagtgggacaaggcatatgtagacgtggagtctataacaaagggttatttgtcacagaaacagatatggtttaacctagatggtcaaagaccacaatttagaagtgagacactataatgacagataaacaattttatgaggcagatattcaagaattaattttaaataagcaaagaatattcggggatataggaaagagcgctattgtttttgagaaagcaatcatgcaaggtaatacaatatgcgattgcctagtcttcacagaaaaacgagggctcattggcatagagataaaaactgaacgtgactcgacaaaaagattaaataaacaactatctgattatgaaaaggtgtgcgactatgtatatgtattatgccacgatagccatgtacctaaagtagagcaaatacttactagacataatcataaacatgtaggtatcctagcttacacagagttcatgggagaggcaatgttaggtgagtataaacaacctagccgttcccctaaaaaatcagcttatcatatgttaaatatcttgtggaaagaagatttaataagaatgcttggtacattcagacggtacggtgataggttagaagctaatggagctaaggttatgaaaacaaacagccgttctggtggggtatctgggctttatgttaaatctacaactgctagaagaatgactaaacctgaactcattaataatttaataaatagagtaggcggtaccgaagaggctacgagagtgttctgtgatgtgtttatccataataggaatcacccagagaaagcaattaagttaagacattttaaagcaaaagagaataggggtgacctagatggggtttaaaggtgcaaaatatggttcttggaatactgtagttggtaagaactatgtaggtactgggggcagaacaagtggtagtaacacaaaacggctgtccacaaaaggctactaccaagtaggatttgttaaagaatatcagaacttgacagaaaaagatattatgttaaaattagagtatggaaaagacttagtgtctagctacactggtgtacctgcagatatgattaagttacgtaaaaagaaagaggagcaaaccctagcatctttagacacagtttattatgttagcattggtaaggaacctgtaggtaagctgtctatacgagctcagagacgttttagagaggtagggttaacatttatatacctagagaagaactacgtacagaggaagcttagaggcggtaatgtacgtagtgtagggtatactaacgcaaccaaatctcagaaacgtaaagcagatagacggaaaagcaataagtctaaaacaactagatagatggaggtaagctatgcttaaaaaagggaaagaagtaacactaagaaaattttataatattatcacagataaggaatcagtattgctaggggcacgatacacaagttcaataatgactacagatattcctattacaacaacttttgaagatgttgaggtagaccttaagaaagaaacagtcgcagggactatttcattcagaccagtaggagaaagacagattaatgcattaagtttgctaaaagaagcaagcacagcttatggaggttacggagagttcctagatgatactattgagaaacctttaatcaatagtgattttgcagtggatgttagtctagcagactctgctttctctaacctacaagagattccatttaacctatatatgtcctccccaaaagttttttatacagaagtatcaattagaggacgtaagcatatgcaatatgtattagaggatgagtcttctagcggtgtaacaagtacattagcactggtattccgtaaaaaattgtatgatggggaaacattgctaggtgtgcatacttacaccgaagcactagcaagagtagagggaattaaagtattacagtttatcgcaaacggttctgtactagaacaagtaatcggtgcagtgtctgttttaggaggtagcacaggaacaaccttgttccctatgtttgacgatatggtaatgcaatttgtgatgattgagtctgttccttgggtgcatatttcttgtgatacaggagcaatcgcttttaaggaagaagacatccgcaatgtaaccattaagtcagctagaccgggagaatataaggtgactatctacttgctagacgaaaaagttacattactaattggataaaattttaaaggaagttgacaatatatgttgacttccttttttgtatgtgctaagataactacagttgaataaaaaataaacggtatagagggagagaattaacatggactacaaagaaaaggtatatgtgggagcacttacttggttaggtactttaggagagagacgatatttagggcaaatgcgtgatgtattagctgtgtacgagctaggtagccgatacgcagggtactacacagaaaatagtgactatgattatatggttgtgtacatgccatcccctcatgatttaatgtaccctacaacaatctataaacaggaaacaaagattgatggaaataaggtagaggtaaaatatatgtctatcatggaatatgtttaccgcattgaaaatggagatttagaggctttacaaatgttaaatgccacaagctcccaaagtttcttcggagagcctattgaaggtattgacaataagcgtactcgtttagttacgtatatgaaagaactagaatacagaagagaaacatttacttatttagcaccagagaagttgtttagaggggttaatggtcgtattaaagccacaaaagcacgtatggataaggctattgagaatgacgatatggaagtagcagtaaaatgtgctatccttattcgttattttatggacttattagttgtgctagcggacggggaatctattcgtgaaggtctcacgttctctcctattattgcaaatatcattagagagtttagggaagactgtgagtcagcacaagctaagacactcattaatactgcacaagtgctattagaggcggatagagaagagattttaaatagtattaaagaccatgggttatcagatggttacgctcaatcagttagacaatatagtttaacaggtcgattgatagatgtactattaggaggatattatgactaagttagaacaaaataaagaaatcttagatatatttaatagaaaaggaaaagtaacagataaagtagaagaatctgccaagattatgctagaattagaccacgattatgactttggtacaggggacattgcttatacagagcgtggcacagataagaagggacgtttctatttagaaagtcgtttgtttattcataaactcatgccctatgggttcattttaaacgctgtagtaagtaaagtacactatggagaccaagaggagaccttagaacgagaggtatcccgtgtatatgagctagagtacaacctaagagataaggtagctgtgctaattaagaacggtaaaccactaaacttctcagaaaataacattagtaacatgttttctgggcacgtagcacagaatattcttgaacaattagatacaatgtctggttcagatatgtatgtatctgtgtataaacgagttagtcgagttaaggatgaacaaattggtaaagtatctcggttctttgatagattgatgaagtacaacaagattgaattaatttataagagtggcgttcctgaaggctttgctttggcttatgcttatcgagtagttgttgtaggagaaggcaaagtccgtaataaatggtacgaacctgtaaagagtgtggactatttagataaggaacaaacaaatccggctaaacacctaggtattccaaagtctatctttaagattatttgtgaaggtgggttagagtggacattctaccaaaaaatagctagtcgtttccataaatcattagttaacagaagtactaacaaaactcctaaatcccccactgctatgaagaagatagagaaagagattgctaagttacaacaagcctatgctcgttttggcggggtactgtataacctttatcagtttactaaagagctagatgaacaatatggtatctcccatagtaaggatattatcgaaacagagtgggaatctatatacgaccatattattgcaggagtagttaacgataactataatagtacaactgcttatgatatttctatggttgcaaacctagatttctacagaactgttcgttatctatactatcgagtatatgttgagcaagggcttacttcacaagcagaggctagatacacatacagagactacttgagagcacaccattatatgaatgcggtacctgttaagtaccctaaagctcttaagactgctcatgacattattaatatgaattaccgaacaatgaaggataaggtattgaatagtaactttgaaagtagtgtagctaaatataaatatttagaagaagtatcagttagaggtggctatattgttaaggtacctaatagtgtggaagacttaactaaagaaggttctagtttacaccactgtgttgctacttatgctcatcaagtagcagaaggttctactcgtatcctgtttatgcgagataagacagagccagatactagcttagttacttttgaggtaaaaaataataaactagtacaagcaagagggctagttaaccgtgacttgacaaataaggagcaggagttcctagacaaatggttagctaaagcagaaattggtaagtattagtttgcttaaaaaggtgaaatatgaggtatgtatagaccaattcacaatgaaaaaagcacactaaacagttgttatttcattattaggtaaaacaacttattttagatagctgatattgaccaacaaatatttcataatgatttagctattaaagttacaaaaaccctactaatacgtggggtttttgcttgtttcaattacatatgaaattttacagatgttctgctatattagttacagaagctaataaaacaaagggtttcaacccttaaaaatgatatttcatataattaaaagttgaaggagtttataactaaaatggctaaaaaagaagtaaataacagttcagtattactgaatctatacaataataagttgcttgtgtctaaggtagacgaggcgttagacgagggtaaaccatacgatttcattattgctttttgtaaagagaagttcgattttgaaattaataaacctgcattatctaggtacaaagagaaacgaagagagtctttagaaacaggagtagacttggaatcactacttgacaaacgtagaaaatcaggtaaaattattgatattaagtctaaagaggtaaccccacttcctaatgaaacatacgataacacatttggacaagtggaacagatatacaatgatgtagaggtgttagacacaatcatacaaaaaggttttaactctctaaaagaggtagactatgttgaagccccacttgctatgaaagcaattgaagtaaaagctaagataacagctaaccagttccaaggtctaagtctaacaggtttaagagagctaagattaagacagtctgctaaagaacaagcaatgactgagattattctacaatttattccagaagaacagcatgaagaagtattcaatgcaattgaatcagcagagaaagagttctatgaaaacttagatttaacagaggaagaccaaagaatcactaaagcgttgcaagcatcaggtatggatataatttaggagggctataatggttgaaaatttgagagaggtaaattataaaacattaaccttagaagaaagtttacatgcattacttgaagggaagacccttattgtaaaagggctagaacaaagacgtaagttagatgtgctagtaaggattttctcagaaggtgttgtacctgttacgcagataagttatgatacaacccctgcggatggttattggagaacaggatattggcagatatatgatttaccgattaacgcccttagcacatacccatgttttatctatgatgatttaaatacggatgaactccctaaatttatgataggggacactgtttattacacgagtaaagaggactctattaaagattccgccattgtaatcagtgtatacaaagacgatgctaacaataagtggtactacaagttaagtagagataacgaaatatatgcagagagtgagattagaagagacaggttataagcctgcctctttttttttaaatttattgttgacaaatatctataactttgttatagtataaatatcaaggatattgataataaattttggaggtgccatgatggcaaatattttagacacattaaagtggttagataaaggggacaaagttactattgaatttgataaagagcggtcgaagtatgcaaagctgactttgcacgattcatcagctaagacaaatattgtccgtaacattgttttttatgatttagacaaaggagtgtatgcttacactggtgaatacacccctgtatgggataacttattagatgatatgcgtaagacacaaggcgcagaacctgaaattaagactacaaaagtaaatcagttagctacctatgaagatgctttaaagtttattgaaacaaatggtacgttttatataattggtgaggaagtaattgttaaggttaaagatgcaaaagagctagcattgatgttaatgtactttagagatgctatggaagaactaagaggagaatacgaccctaaaaaacatcatgtagatatgacaattgaattatcaaaagatgttttgaaaaaaatggcagtacctagacatgaattagacttatctttaggtggcttaatgagagctgtatcacataatgttggagaagacctttttgaaactcttggatttgactacatgaagcaagcttgggaagtcttagttaattgcttgtcactagacaccatccatgaggtacctttccgtgtgctagacgaattagagaaagtaacagatagcatgtctactacagaccatattgttaccttgtatgccggtagagaacttaaaaaattctattcagaggaagagtactttgatgtaatcacacacaatttagctgatgtgattatggattgggcaactatttttactacagctgttcttaataatacagaagatgatgaacaccttaaagagttacagcttaactttgagagattcaagttagatgtagcagaggttctattaggtaatgttgcaagacatttgctatatgcaggagttactgatagctttaacgaagttaaccattatgttgtcggagcaggtaacctgattagaacagaaggtttgattagaatagaagagttaactggaacattagacgaccctaaagatgaagatagttctgagacagataataaagagttactagatgacatctttacaaatacaggtgatgatggtgttgaagactttacaaaagaagtagacgagcttgccatgtttgagaacgaacatgctgaggaacttttggaagtcaataacaaactaaaagataaccaagagttactacgtaaaactgtagaggcgatgggtatggcttcttactctactattgattcatcatttgaacaagaggaagaaacagatagcaaccacacagagacttgtgaggataccagagctttccaaatgttaagctatgcagtacgttcaggagacaaattacttgaacgtgtagagaaccacccacaaactgaaaaagggttgaaaatggctaaagattctctaaaagagtttgaccatacagttaaaccagaattagaagcttatttaaaagcagaagagctagcggaagacgttgatagacatgcaattgtaactacaattatccgtatcaaggacactatggaagcagatatggacgactgtaccgacccaatagagcaaggtttattctacgcaggaagcctaaatatgttagaagaaatggaatcattgttacgggctagcaatagaggttatggttgggacgtaacagctatctatcttgtcttgtccattgaactagcttatgggacttacgggttgtctgatttagactttacaattaaaaataaagaggaaactcgtaaagaagaacaagatgcaattaatggcattgtaaacttcttagccaatcttttaaatacagtactagaagaagaaacagaatcagaagaaacacctgtagtagtcgaagaggaagaggaagaagaggataaggatgacttctcactatctacagaagacactgctaagctattggcagactggtcaaatggtctacctacgtatgtcgttactcgtaaatacggaattagtatgggagctttatactctatcttatatgcaaatggggcagacgttaaatcttctaaagtagcagaacgagtggctcatgtggaaaatgacaaagatatgttaaacgcagtcattcaagactacaagaacggtactcgtttagtagatatttatactaaatacaaattatataaaaatggtttgttctatcttttagataaatatcgagtgccacgtagaggtcgtacaaagaaataacaatgattaaggtagtggtgttaaactactacctaatcttttattagggaggaacttaattgattctttttatatttagcattattacaatgctatccatgttcttactatatttgtttgggatggcttctgtagccctaattgaattagggcttcttatgggtagtcaaaatgatataactaaaggtgcacactctttgctttttacgggtgtcacacttactgtagtcaccgaaataactaagcagtgtttattattattttaaaaaattggaggatttagtatgttgtttttttattgttttagcagtatttataggtgggcttgctttatggggaatgtatgatagttatgggtacctagactgggcttcatggttatttagtattgtgataggctctgctgtagctgcttttttcacactagcagtggttggaattactttcgatgttgcaccaagtcatggggtaacgaaaagccatgagctacaccctatctatgagaatagtaaagtagttgtagaggctaaaaaagaacagtttgagattaatgtagatggcggtttggtagctattgatgcagaaggtactactatcctatctactaaaggagaaattaagcctaaaattgtgtttacagagaactatataaacaacaactggtggactcgtttcctaggtatagcaggtaaggtaaaagacacctcatcagttctttatttagactcaggtaccttagtgtacaataagccggaaaagaacagtagcgcaccagatttaaaaattaaataaataatttagaaaaaggggcttgcataaagtctctttttatgttaatatgtatttatagataggaggtaagcaatatgtcttatacgaaaagagcgttagaagctagaggatatgactttgacacaatgtctatgctagagaagatgaatgctttactagaactattagaagaaccagaatttcaagaacagatgaggaaagagtatgaagagttttctaaggagtgtgctacaaatggagaatgaaaagttggagtcttactttatgaaagagattgcacctattttagatgaaatagagatgagtgaagagttgataaagggaatggagaacaacaacccatccgatatgattacagtctctttttccaaagaagaagtagacatactcttagcaatgttagaccttgagttacctagattagacagtggttctgaattgtttagccctaatctggtaagggaagctaaactacaattaattaagaacaagctaacttcaaaatgatttctcactagaattaattagtgagaaaaaaattaaataaaactattgacaaataacaaaaaatgatgtaaactaagtttataagataaagaagaggagagatacacatgaatgaacaaaagaaagtatatgcaaaattaacagaggacgaggcagtatttgcttgtgaactaggagataaaattaaacaaattagagagagtcaagagctatctcgattagaacttgcaaaacgagcaaaagtagaccactcaacattaatcttaattgagcaaggtaaacgactaccaacattacgtattatgatgaagttgagcaaagcactacaccgagaattagctattagctttacagattaaggaggggcatcatgagagggagcctagattattacaactatttgtaccaaacaattgaaaatcgacctacggaggagctagatgtcctttatgacggtctttataaaaaagccggtgacctgtttgcaatagataacttccaaggagttaaagaaggcagactaattttaaaaatattaaaggctattagagaagaaattaatagtagaattgatgaagaaattgacctttacttgtataatatctatgacagtatatcagatgaagacaaacgagtaaattggttatatgaggtgtaggtatgtttagtgttgttaaggctgacagctatgttaaatcagacatagaaatgtatgaatttaagaatgtaaaaagtttggcattgactaagaaagagaaagaactatggtcaggcaaaattgctaaatatgttaatgagtttattgtaaatgcttatggagactaccatgggaataaaatacctgaaataaatgttgtaatcaatggtaagctaaaaaaagtcctagggtcttttgtccaattcactaacacaaacatacactatatagagataagtggtaggtttgttaaagaagttattctattacaagaaacaccattagctcaaagagcgcttgatattttaatggatgtagccagacatgaagctatccactatacactttgttatttaaatagtttaagtgggggagacctaccaacgttcaactaccatgacggtggggaagactttgaaaaagatttatgtttgacaggaacttcacctagtggcgctacgaaagaagagtatatttatagttcttttacactaggggctatcagatgccgacaccatagtacttgccctgaatgtgggttggaaacatacatgtatacacgaggacggtactattgctataatgggtgtgtaggggataacggtagaaaaattatatttagaccacaaggtgatattgcaatttatattgatgaaccaaaatctaaagctaaaccaaaagtagaggaagctctgaaagactataaaggagcgttaaagctaccttatacaggtacggaagaaataaaataaaaaaaatagttaaatgtattgacaaataacaaaacatgatgtaaactaagtttataagataaagaagaggagagatttattatggcatacgtaacaaatattgatgtagtagcagatgggttagatttatataatgggaactatgtggtggaacgaggtcaagtagttacttttaaactacatgtagcgacatggaacaatgagcctacacccgaaaatgcttatgcgattattcgtaataatggggtagattataagagtaaggttgatgaatttggtaatgcagaggttaccttcccagttaatggtcgtcctgaccaagtgacaactagtatctttgcattaacttctggatatgagggggatatgcctcgtgtaatgtcagctatctttagtgacgaaacagaaattaaacaaactgtaatgaacgttacagcatctattaatggggagccagttagtcgtgaaggtgtatttttagaacgagaccaagtagtcactgtagatgttaaagcaacattatctacaggtaagttctgggaaggtgcacaggtaggtgtgtacaataacaacacggaatacttaggtgacctagatgcagatggttatggttcagtaactttccaagtaaaaggaaaacaagggatggacacatcagctatctacgtattcgttaaagaccatgaacgagaagctacactaacagttcctgtgaagtttactaatactactgttactacagaaacttctacagaagaatcgtctactgttgatacgactacaggaacagaggagtcttctactacggatacaacaactgtagaaagctctacaacggattctacgtcttctacagtagattctacagaaagtacagtagaaagctctacagagcaaacagtgaccaatgaagacacttctactgattcaggagtagttgaaactacagaaacttcccaagtagcaggctacacagagtctacttctagttctacagagtctaaagaagttaaggaaactcatactagcactacagaacctgctaaagagttgccatctacaggcacagaggtgaactatgagcttgttgggttcggtggtgtaacattaacagttgtagtggcactagtagttaaaaaattgttgaataagtaagaaacacaatattgcgaccctcattaattgggggttgcaaattatattatttttttaaataaacctattgacatttaacaaactataaggtaaactaagttcataagataaaggagggaaacaaatgagtcaagtaagcaaacatggagaaaaacgtgtacgtgaacgtgtaggagtgaataagagctctgtagaccgacaatttgagttagctttagaacgaggatacagacaaaaggagctaacaggtcgtctaaagaaatgggtagtatcaagagtatttaactctaagtaccctcaaacatgtattttatataatggtaaatgcttcattgttagcagtgaaggtacactagttactgtgttaaatattccaagtaatttactaaaagattttgcaaaattatctaagaaaagaggaaaataaaatggatattatggacattgagtttttagaagaacataaacaattagtaaaagaacatgtagaacaagaattaaaattaatgcaccctcttaagaagttacaagtaatgacagactggttaggagatacagaagacaagctttctcaaggagacttagattacttcaatgacttaacagaaacagagctaatagaggcaatggatgctagtgaaattgtagagtcttattcagatgtcttgttagattttattgactactacaatattgatttaactggtttagaggaacagctaggtgtgtaaccatggataaggctgaaaaggtagataacattgtaagacaggtcacaggggctattattaaaacaactgcaaaagtagcttttattgtttttgttttaacctttgcaggtattttagtaggttattatagttattcatttttaacaaatgcagggtggtttgccttacctatgatattatcagtagatttgttatatgttgcggtactgttaggcgggctagcctttatatttgcagaggtctacaaagtagttttagaagtgaaaaagatagttaaacgaggagggcaattatgagtaataaaacattagaacaaagagtaatagatgctaacaaagagataaacgataagcttaacgaatcatcaattattcgtaaacaaattgaagaattagaggaacaggaagccatcttactatcagacgtagaggacttacttgattacttagaaaatattggagtagacctataggagggacttattatgaataaaaaagtagaggaaatgacaatggaagaaaaagacaaagcactaattgcaatgggacttattgatgtaacgcaggaggcagactgggtagtattagctacttgtgaagaatgtagagaagagtacgaaggagaggagtacgaagaaggggactgtgcagagtgtgaacattgtggaggagaatactttatgattgagacagctctcgagggtactcgttgtggacgttgtgatgactactttgatatgtgggacgactactttgagtttgagaatgaaggtaacccatataaagataaacatatctgtgaacattgttatgaagaactagtatctatgggaatggaagagaaattttaagatactactaagaaggggacttaatcatgaacgaattagaagaacttaagaatacactgattagacaaaagctttcaatgttggaaagttacgaaatgagagaagcatcattttggataatgtttaatggaatactgcgtactatcatgtcagtagctgtagtagcctttgtgagctatgctaagcatgtaagaccagataatgtagccacatggtttctagctctaatttgggttattttcctagcagaaggtgctaaaggtgcttatgatgctattgcattcggtattcaccgcaaaaaatttgctaaacatattaaaaatatgcgtgggataatcacaatcacacaattacttattgaagaagacgaagagaaattaaacggaggcaagctagatgagtaaagatgagaaattagttgagtggtttgtagttgccttaatggtgattgtgtggttgcttatcacgttcagtatcttatacacaatagtttccttacctttcatggtacacgaaggggactggctagggattgtgcgaaacgtactactggacattgtagtattggtaattggggttgtcgctacatggttgcaattaagatttaaaaaaggaatggaggaataattaatgggatatttagagagtgcaattgaagaaattgaacgagtactactaggaaataaaagtcgtgacaccgaagaagtttatttaaacaatgcaattcggtatatcaaaaaagagttaaagaaaaaagaggtagagccaacgtggttaaatgaaccacagacattgttccttaattggtttaacgaattatacgcagtaggtggtttaactcatgtaacagaggcagtaggttttttagaatccacaggaggtagaatgaagtatccagaagcatattctgctttcagtaatttaagtgagaatgaattgcttgaggtttacagtaaattttatacagggttattcttaaaagcacaagggggtgaattagaatgaactttcatggtaaagtatttcatgataaagtatttgacattctttctcgtgattaccctgattggcagaggtatcagacagagaaacgaccacatcccaatgagcttagaaaagactttgccattgatagtacagatagtagatatgaagagtatgttatgggagagtttaatgtagaaacggctagcggagatgttaaagtatacgcagtaggaattagaagagtagttcataaaagagctgaggaggagtaaatcaagtggagtacacagagaaagacattaaagaaggtatgaagttacgttgcacagataatagtaatgtaggttactgggaagttgataaggtttacgaggtaacacgtaataaagaccttggcttagttatcgcaggggaaggtgaaaggagtcacagaaccgtaaagtatattttagaggtgttaaatggtgacagcaaaattaaatttgaagttgtagaggaaaagcctgtacgatttgctaaggtaacttgtgtataccctcctgatagaggtcttgtagaggttgggcattgttatgaagtgcttaaagagttccctacaggaagtgtgcgtatctaccttaatagtaaactagggaaccattcgttactcccagaccagtttgtctttgtagatgaaccatcaaatgatggagaaaaagacgtagaagagctagatgtagaagctaagattctagctgatattgaacagctaaaaacggaggcagagtgtctgtttgctaagcgtgaccgtgtaaatgagcaagcacttaacttaaatgcaaaagctcgtaagttagaagaatctttagaggtactaagggagtacatgtagctaagtgtttttatgattacatctattaaggagatgagagaatgatttattatattaattttttagaagatttcgcatcaagttggagtgcagataagcgttatcgtgttcgtagaattatgacaactggtagctacgctattattgacaactatggtcatgtcagattcagcagtgacacagcacgaggtgttcttaagaatatagagcaggagtatgccactaataaggttgagcttacactagtagaagaagaggcaatgaataagcctaggtttaaagtaggggaacgagtgaaagtgtccaatgatttacaggcattcgggatagaatataagactcacatagcctctaagatgctaggctatgcaggcaaggaggctactattacacgtgtttgggggagtaacgtacgctactttattaacatcgatggtacacatcaagattggtgttggacggaggacatgttagataagattgaagaagaacctacactatctgttagatgtgttgaggcagttcaccccttttggacaaaaggtaaagactacgagataaaccttacatctgatggtcgctatcgggtctgggatgatgaggaagatggtagcagtggcaaatccataaaagaactactggacgttattaatagtagcggtaacaaatttgagctactagatgaaacaccctcagaagcagaacctagactaaaccatgacatgtctgacttagagaagatagaggctaagattactgccttatcggaagaatcttatcagctgttcgagaagagtgaagagttaagtactaaagcaattgaactgcaagatgagtcaatagctttagaagaagcattgtatactattaaacaatatttataggaggagatttaattgaacaaaaaagaaacattattaaacacaacagtaacctttttagggggaactagtcagagtagccgacctaaaggtaagcaaactctttgtgagatgcaaaaatcggatggctctgtagaatttatttttgatggaacagtattttatgtacattccatggtagtagtctatatggcaaataaaaaacattcgatgcaagccacagtgtctgcaatagatggtaactacaaatatgcgggtattacctttaaattaaaagttgactacaaagaaaatacactattattggaggagatttaaatgcgtaaaaatgtaatttgtagattagaatgtgtttcaaaagacaaagataacttaggtgaatggactgtagataatatttaccctgtgtttgaatcagaactagggaaagtatacatcctcgatgatgaaggtactacttgttccagagatagcgtttctcttattatctctagtatggctagctttggggtaacatttagagtagcaaaagataaagcagaagaccctatccctagcaatccacaaagcagtacatcattagaaatagttaaagggtacgagcacttagaggagtttatagactcactaagtagcaaccaacgtgtagtgtctcactcagtagaccctaactctcaatggcactatatcatttatgaaactaagtcagctgaattgggcggagtaaccttagaggaactactagacacactagtgtataatgtacatgttgtagtgatggaacgtagtaagagaacatacgagccactagaaagtcacacgtttaagtgggaatatgggacaaagaataccgaggattgggaaaaaattgtacctttattaggttacaaggtgtttaatactaacctcaatagtaacagagggttccatattactattttgaaataaactgttgacaactactatagtccatgctatagtaggtacatagataaaaaaacaaacaatattaggaggtagcataaagttaaagaaacagaaaagaagtatagcagaaagtataaggggctagaatttgaaattattatcacttattaccctgaacaagacatgtattttgtaattgtagtgaacggacagcatcgtacactacttaaggttacagggaaagagtgggaaatgagccctcatacagaggaagctgttattgaggtagcacttgatacatgctacacctatattgaaaatcaagaagcgcaaaagaactaggttaaggagggctatgatgataggggatttcattttatggtttaaacaagcatggaaagaaacattctgtattcatgactacacggttaaaggtgtgtacaaaacactagataaccatggatacttaaaatgtaaaaagtgtggaagaattaaataggaggacaacaacatgaaccagagacagattaaaaaacgaatgaagaaagttttagctattttaaatgaggtagaagttgtagattcagattacgattcaggtatggtattgtatgtagacgttgcggataacgagcagaatagagatattattaaagaggtatgcggaatcttaggtcttgataaagagaagtttattgcagagtgcaaagaatcaagactctatgaggaaacattgaatttagcaagttgttggcactatcttatgcaaaaagaacctaaaaaacttactatttggcatagtgttagtaaagggttctctttagaaagatacagtgaagattgagtattgttacatgagaagtattgggctgtcgctatcagattttatttaaggagatgaaacactaatgtttaaaaaagataaaaaagaagaaaagacttatagagaaggagacctccttaagactgtagggggttactatccagatgctaggttgagtttaggaatcacatatccattgtataaaaccaccaatgagggttggtatattatcaataacgaaggtagtcgggtaaccttaatcgaaatggatgctttaggcattgactacgctgtgatggaagaacccttattagaattaaaagaaggagacccattgctagtcgtgtccgaccttaagagaggtgttcgaggcttagcaggtgcagaagtacagtgtttaaacattaccggtgaaatggcttcactagcaggtacagttgttcattatgataaagatatgagccatattgcaaaggggctgttcactgttaaagagaacgattcttattggtgtgtagcgattgctattccactaaataaagtagctgaccctgattttgcattagagcatttgcttgctacgttaaataaaaaagcctctactaaacgtctgatattgaatgagataaaatatgatttaaaccttcttcaccaagagctagacgaggtgtccaacgaattagagaagctaacaaaaaacattgaaacaatctataataaccggtaggaggtacttagatgagtatgccgagtgatttagggaaaacattaaagaaacctattgtaataaataagaatcctgatttttatgaattagcggtaggtggtaaagttatctacaacgaagaagtaatggagattgctaaagctttctctaataagaagaccaagtactacctactaaacacacgaagtaacaaacaagtatgtgtgccagtgtatcatgtaagaccttacgatacccaagtagagggtcttaaactaggtgatgtcctagatgctatgcacattatgacaactgtaacgttaagagcagtaaacaagcacgggtttgttgtcgatgaggatattattgaatgtttagtagatgacgtcccagaaaatgcgcttattgttactagtgaggtatcccgtattcagccagaggattttggtaaggtaactattgactattttgtttagatatgttaggatagacttaagataggataggatacacttaggatgcacttttgtttaggataggtttaggataagataggatataggataggatataggataggataaacttaggatagacttaggatgcactttggtttaggataggatgggggatataactatgagttacgttaacgagtttgaaacaattggagattggttagatagagaaatttatgatgtgctactaagagatgggcatgatattgacgaattagataattggggaatggctttgtttgccttaagtgaaggttacgttctaacagatggacttgataaaccattcctagagttaactagagaagacctagtagcaggctacaaccactttaaagaagaactgaatgggtggttacgaggaggtaaactgctagaagtctctggtaacttagctacaattcaagggttcagttttgaccatgacgatgttttattcttagaggataacaacaaagcttatgcaatgctagtaggtattatcattgaagcaagagacacatataaaaatggtttctgtaagggttactatgtaataccttaccaagattgagttagccttatggctagctttttcttttaccttaagtagcaggctacaaaatctcctaagtagctggctacaaaacgaaaaatcccctaagtagcaggttgcaaaatgagaaatcccctaagtagcaggctacaaaatccggatgcgcccggctagcggtggagagtcaagccatgcgggttcaccttaatagctaccgtccccagattgtcggtttttctccctttatatagtaagaaaaattatttaaaaaaaatgaacttttctattgacaaaaaacaaaagctagtataatatagagcgtgtaaggaacaataacaataaaaaaaataaagataaaggggcgctattaaaatgaacaagtataaatttacctatgcagatattaaaaacctatcagaggaagaaaaagaaaaagaattaaaaaatcggtgtggtgttttagcggtagaatgcttaagcactaaacagctacaaaagaaaaaacctcgatttatggttttcttaaatactgttatttttgacagtaccgcagaaacaggcggacaatacgcaacggcaaccgttaaaaccgaaccgataggggacggacgttttcgagtgtgtgacggttggggacagctttctaatggaattattgaactgttaaaataatttataaaaaaaactattgacaaataacaaaagataaactacaataaacttgtcagataaagaaaggaagttataaacatgtttaaaagattagaagagtaccgcaaaaatttatctaatgaagaacttaaaattttcaacaatacaatgaagctattaaatgataataagacagactttcaagaaagaacaaaaaattttgataaagaactacaatatacagagctagaaaatgaaaaagaaaaaattttgatagtattagacactattcgagtgagtaacgaaaattacaagaatgttatatctgaaaacttatatcattctattaaagaaatgacaattatttttgagttactttataacttatagaaaaaaaattaatcaaaactattgacaaaaaacaaaagatagtgtattataaatttataagataaagaaaggaagttatgaacatgaatgaattagaagaagtgaaagaatggaataataaaattgaggaacaacaagaagtgctaaacaaggttattgttactttttataaagaaatcgatttaaaggttaaaatggtaaaccgtggtttgctagggcagttatcagcttttaacgaactaaaaggaatgctatcaggtatcgagctaacagcaaaggttattgcacctgataacgtgctacctattacaacccacaactttttagaatatttatttctaggggataacgaacaacgagcatatgcaaaagaatacctagacggctttttaaaatcagtagaataaggggaggaaaattttcctcctttacataaaaaaagattgacaagttaaaagaaccatgataacatataaatgtagacaagggaggggctttacatgatgaacggactaaaaagacttatgaaagctaaacgatacaagaaagaagtaaaagaaattatcactatgcaaaagaaagcaataaacgaactagaaacattaaataaaaatttaaaattaatcaatcaaaactattgacaaaaaacaacaattgatgtatacttaattcataagataaagagagggaggtttaaacatgacaaaagaagagctaaaaagttacctagagaattataacaagcctttttcaactagtatggataatgttttctcactgtttataaacgatgtgagagccgttgcagatgattttagaaaaggtgaagcgtttatatatacatgtgccgaacttatagaggaacaagccgaaacactagaaaaaagtgacttagaggaattagaagaaaaatcaggggaaagccttgttatacaggacataaacggctatttatattttgtttaaaaaaaattaaaaaaaactattgacaaataacaaaagataaactataataaacttgtcagataaagaaaggaagttttaaatatgattatcgcagaaaatgagttatacttagttaaaaatccattaaatgagtgggatatgaactaccatttaattgaaaaagaaacaggaaaagactttttgattgatataggtgacgtggcagacaatgaagaagaaagagaaaaatatgaactaggtttactattttcagacttgaaaaatcttatagttgatttgcttattgagtatagttggaaaactatttaaaaaaaattaatcaaaactattgacaaaaaacaaaagatagtgtattataggtttataagataaagagaggaagttattgacatgacagaacaacaatttaaaaaagagcatttattagaaccaacagaatggcgtagtgggggctacttagacactagtttaatcgaccaatcacaatcttattatattgagtcacgtccgagagtttacggcgggtgttacgtttatcaatatgttacaatgaaagatggcacggtttacgagctttacagcatgacggcaagcactagaggaattgttgcacataactgccacgctagaaacgtattacaaagagatgtaaaacaatatagagatagtgctattcattattaaggaggggagggctttcctcctttacatagaaaaaaaaattgtcttttctattgacaaataacaacaattgatatatacttaattcataagataaagagaggaagttttaaatatgaaattatctgatattattttagtaggtttattagttagcattgtactgctttggggctaccttagcattatgatttgcttacaagtttttagagcgttaggcggttgggatattagaacgttaacggtttgcagtggtttgctatttgcttatgtttttggtttaaaaggaatttgggaacaagggacagggaaaagcaaataaaaaaaattaatcaaaactattgacaaaaaacaaaacatagtgtattataaatttataagataaagaaaggaagttatgaacatgaaattaaacgttattcatttactattttgcttatttcaagaacaagaaagctattctattttaagttacgaatcaatagacgaattttactctaggttaggttatgacttagagagtgagtggctacttagggacttaggtattaatggaacaagtggcttagcagagttgctaacagattacaataatttattagagaatgagataacaaaagcagtcttttctgataaatggttatagtttaaataaaactattgacaaaaaacaaaagatagtgtattataaacttataagataaagaaaggaagttatgaacatgaatgaattagaatgtatttacgacagtagaaagagcttttatggaaaagctaacctagtagaagaggaaaacggtatttctctttattcatatgatacaaaagttgcgacaatttatactaacggactagcaaaggttttcggtacgtactcacaaacaacgttgcgacatattaaggaattttttaagcaaaacggactaaaagcagacactaaaaaacaaattgaaaaagattatctgtaatagttgacaaaaaacaataactagtatattatagacttatagagagagaaaggaagttgtttactatgttaaaaatcacaaaagaaattactttgggagagtttgaggcttgggaaggtgggaaagaccgactagaaacaattaaagaattggatattttagatgaagcacaacaagaaatcgagttgatgattgagggggcggaagaggtaacagaaatgactataaacgatatcttatggtttgagatggacgagttcattgcacaatttgaggaagaagaggaagaagaatagaaaaacagggaggggcttcctccctttacatagactaggagggcttgagatgacgacagaggagaaagcactaaacattgcagagaataaaggtataacagattataaggttaaagggaacgtattaagctattatactagttatccaatggaaaaatgcacataccttgtaactattgacattgaaacgctagaagaagaaagaaaagaactcaaaaaatattataaaaaaggcttgcaaaatgcttgcttataatctataatataaagaggggtggcggttactattaataatagaataaaaaaattgcaatatgaaagaatcagaaagctagaaaagagaaaaagaggtgaaccacctgaatttattttcaacggtaactattcattagaagaaatagagctattcttgcattttagaaaaaaaagtgagggcaaaaaatgagcgtggtggctttgcttggtttacttgtaaaaattacatttatttttaaattgttagcagataaaaaaaattaaaaaaaactattgacaaataacaataactattgtatacttaattcataagataaagaaaggaatggtaaagatgacaaaaacagaactacaatataaaaaagcaattggggttgcaatctttgcaacaagtgaagaggataaaaagcaactaggcaacgtggcgccattcagtatttatgagattttagaaattgacttaaataaaaatcgggtatactatgctttaaactgtggggaacggcatgcagtgtgctttactaaactacgtaaggaagaagaaacaggggacaattttattttaatcaataaacaaccttttttcttaaaagacatacacaagggtttgacttggtcaaaaagtttataaaaaaaactattgacaaataacaacaactagtgtattatagacttatagagagggaggaaaaaaggcaatgaaaataggcaaaaaagaagagctagaagctaacaatatttttaatagggcagatgagttactaggagctgtcacaatggaagaactagaaagggataacggtggaagtattttctatgctgacgggtcgcctgatacagttttatggcacatgaaaaaagagttttctctcaaaccatttcactgttattattttgatgggtggtatattgcactaattaatatttaaaaaagtttataaaaaaactattgacaaaaaaacaaactatagtgtattataaatttataagataaagagaggaagttataaacatgacaaaagaaaacaatgtatttttaaatgaaaaagaactaatgaaagaaattatcgaaactttggaaaatggttttgatggttgttactgcgacttgcacaatgaagtttttaactatggtacaaatacagataccgaggaattagaagaatatggaatttttaacgcaatcggagaaattcaggaatacgaagaggaacacttcggcgcaactctaacagacctcgggaacgcttcggcagttgctgatatgctttactatattaaaggtcacgagtttttatttgatagattagattttaatgatgttttagcagacgttgcagaggggctaaaattagataaagacttatggaacgaggaagccaccgaggaagtgaacaaggctattattaaatgcttaaaaagagaagtgccttggttagtagattagtataaataggagggttaacctcctttacatagaaaaaatataaaataagggaagtgctaaacatggaaacattagagaatttcggttatacatggcaaggaataaaagaagttacaaaagaagaagcagagaaaaacgttaaaaacggggttgacacttttctattatatccagataataccgagagtttagttatatccttagatgaattggaaacagagggggtacgctttggggttgaaaagcccgtgcaattactatttaaggtatctaacagttaccacaatacagaagaagtttactacggggaaaacgtggaagagatagaaaagaagttgcatgactcactagaaataacagccgaaaacctaacggggcaagaaatagaggaagattgggaaaactactataaaacatatgaggaagcttgggaagcaacttacaatggtattctatcacagttaaaaagtgaatgcactattgaaaaaatgtaaaaaaagtttaaaaaagttattgacaaaaaacaaagcatagtgtattataggtttataagataaagaggggaagttataaacatgaaactaacagaaaaagaactaaacacaattttaagagatgatgaaacagggaacgggggaacggctttcttaggtgaaacactagccgacttcctagaagaatcaggtattgactttacaaacctaactattttagaagtaaatgaattactagaaaataatggaattagaccgattgaggtagtgccatgttaaaaaatatcaaaaaatcagataaactcactagaaaagatatacaaggcttttggggggatgaagcaaaaacattagaagaatggtataagtcaatttcaaaagaatcagacaccgataaaatgattaatacattgaaagaatatgcaaataacaacgaatttcatttcgtaaaaggagagcaaggacaatgacaaacacaaacaaccaacaatggaatcagaagtttaatgatggtactatgaaccagaacaaccaacaaaaggaagttatcactttacaagtcgcagaaagtttcgttagtcagattttaacaaaagaatattcggtgattggtttagttattctaatgttttattttatgtttggcatgtttggcattttcgggggtgcaatctatattgctttcactcacacaaaccgtaaaatcggggcatggcaacaagtaagaagcgtatacactattaaggaggaacaagaagaatggaacaattaaaagggctaacaattagagaattgattaagaaactagaagaagtgccagaagaaaataaggacttgcctatttatacttttgaaaatgaaaactctttgcctattaagggtatttcattgtatgatgaaaatggtaaacactcacaagaaaacccgttaagttttgatgtaatcagataaggaggggcaaagatgaatagtttcatgaataaacaagctaaacaggtagaaagaagtaaagaaataaaactagtggaagaagtaagaagagaaaacgtaaagaaacgcttttcggaggaagttaaaaagtacctagaaaaagggtatacaatcagattagaaaataaagtttttccatttgctttaatatctattgacctagaaaaaggggaaaaggtcataagtcttattcttgtgaacgaatatgatggaatagcaaactatactgtaatgaaaaaggttaccttaagagaaaaagggaatagagctatcctaaaaagaatgctaacggataaagatgtaaaagtagtgagtatgtggaaaggaatataaaagaatgagcgtatacagtttaaaattactagcaatcttagggatagtattattcttttcagttatcgggatagtgtacgataataaacaggacgaaaagaaataaatatataaagaggtaaaggactatagagctatagaactataaaactatacacacttataggaataagaagaaaaggggctatatacctatatacttatatacagatagtccctaacaagcaatagtaagggaatacaggaataagagagggagagggaaaggaagagaaaaggaaaaaggaaaaaaagttgtttacctgagattttaaagaaccgacttcatcaaaaacccgacaagggggcgcataagtctatttcaaaataatctgaaataagtatagttattactgtttatagatgattatccttaaatatctgaaaataggggcgtttattcgattatatagttaactatcttatactattaatcatctagcctattactgcattcattgctattatattctatatagggggcgcttatatcgtttatagtgtaattatgaggggaacggctaggaacgcttatacaggcttatagagggctttaaatgcatagcctatttatacatatattggaatacacaaggaggaggggcagaaagttagtaggttagactgttaaaaacaaacgggggctagatgcacattgttattttactgattgagttaggttagctagctaaaataagaatgctattgtagcaacgtttataagaaataggggtgtacttttcccctagggaggttttaaaagggtataaaattcttttgttatttaattaaaaatttcatcttagctattgacttttaacaataactattgtatagttaacttgtaagataaagagaggggggaacttagaaatgaaattaaaagaatttatcaaactagcagaatcaaaaggcgctacattagaggcatataacgagctaggaggttatgaactaactagaggggacatagtagaccagaatcccgttttaattgcttacatgcaagggactcacagcgtagaaatatcaaacgaggaactagaaaacaaggagttaacagagctagcgtttgtctataaaaatgcaagttttatttatccaaacgaaaaagaattattgtcaggactaggactatagcacaacggcgtataaagcccgtaactaagttttaacgggctttatatataaatacattatgagggcttataagggcttatgagggggactaataagaatgctagaggtgggcaaatttgtacgaggtaataacggcgcaagaacttgggtgggtcagattgtaggtatagacagactagcgggagaatatcgtgtgcgtgacgttgtaacaggaatatacttttatgtatcttgtagcgctgtttatgaatgcgctagaccataaaacatttaataaaaaaatttcatcttatctattgacttttaacaataactagtatacaataggtttataagataataggaggggttgcagtggatacagtaacagatattattgatgttttaggcattattaaacaggacatagaatataagggagagcgtataaaggaactagagggacaagggaaacaggaacaagcagagctattagaagcagaagtaaaaggaatgagggaagttgttcaggacatagaacaagcactataaaaaaatttcatcttatctattgacttttaacaaactatattgtatactaggtttatcagatagagagaggaagttataaacatgaataacaacaaattagacgaattactagaagaggaatacagcacactagacgaattgctagacagtaaagaatttaaaaaacaaatgaacaaccttaatcacgtcccacaaatgcaaccgcaaagccataacagcaatacgctagcagacacgggacgttatccagaaaaataaaattgaaaaaaaaaggggttgacaagttcagcccctaatgatatactaggtacataagatagatagggaggaattttataatgacaatcgaacagattaacgcagaagtaaaacaacaagaaatgcttggtaacaaattagaagtaattcagttaggtaatgatatttacatgtatattaacggtgaaccatacaaaacaatcgaattaatttaaaaagtttcatcttttctattgacaaataacaacagctagtatataataggtttataagataaagagagggagttattactatgacaatcgaacaagtgaaagactacggcaaagcatacggaaaagagctatcaactaaggaagtaaaagaattttttgagaaacacaacgacatgccttcactaatggacttagcaaagttttgcggggcaatgaacgaggacggaacaaaaaattaaaaaaagttattgacaaataacaacacatagtgtagtataataagtgtaagagggaaagggttaaacctaaaaaggaaaatgagtacttctttcttacacaatacatatcagataaagagaggaagttattactatgacgccagaactagcagaaatgaacctaactaaaaatgatagcccattttcgtttattaatgaatcaggtgttttcattgaaccgattaagaacccgttttcttgtgagggtacttatttacaagcttgtaaggacgtagcgggagagctagaaacaaataaagaggtagggaacgaaatcgacaactatttaaaaatgcagaattggctaaataagttagcatatgaatatatttaaaaagtttcatcttttctattgacaaataacaacaattagtataatataataggtgtaagagagagggaggaatttcataatgaaatcaattatcatcaaacaaatcaaggacggttacaaaggcattttagaacgtaggaacaacggttgggcagatgaggaactaaacagctacacaacaggcgtaagcaatacactattcgagcttataaacgacttacaagacaatggtgttatcagtgaagaggaagccgaagaaatcgaagaagtattttcaaacactatcgatatattaaatttttaaataaagttattgacaaaaaacaataactagtgtagtataataagtgtaaggaggaataaacctctttacaccacacaacagaaaggaagtttttactatgacagaatgggcaaacatgaataaagaagaggtactagaattacttaatgattggtttggcgttagtgactatgatacagttatgggagagttagaggagatgaaaaaagttacctttacaggtagcacaaatcaacctttactaggtggtaacaatgacttaatcggtttacctcaattctttaaagacaatgaagcagaatcagagttgccaacttatgaagaattactagaggaactagagaaagatacatggaatcttgaagcagaggacaacacttacaattatagtggcttcctagaaagtgaatcagattttaaagttattcaggcagaaaattcagacacgactattgcattttttgcaatccatacgggtatagacataagagcgggctactcaaaagcaatcccagttatttttgaaacttactacgattttcaagagttcctaggtaactacttttatagtcaaggttactatgcttttaaacacgacaacaaggaatacacaatcagtttagatgtttcggctacctcggaatatgtacgaatttatataactgataataataacaacgagttacaactagactacgaacaagaaacttgtatggaattagacaaagagagcgtagcagaatacctgactagccaaggaattgagtttaaagacttgaaacccgcattataaaatataaggcactagggagcttatacaatagagctacaagcttcctagtgtaattataaggtaaacagctataaacgcttatacgagagaataggggtctttaaaattaagtttaagcggatattatgaactgctaaaattgttgagctaatctattgacaaaaaacaaaacatagtgtaatatattaagtgtaagatgaataagaaagagagtgattggaatgagtagaaagtatagaggttttgatacagcattcacaaaagacggcgtttgtgtatacgtgattaaagatgacaaggaaaagggtacggcacttgtaagagatactagaggaggggacgagtacacggtatctaatgagggtatgatatatacaaaagacatggaaagcatagacgtatatatgccgtggtaggcttataaaaaaaattaaaaaaactattgataaaaaacaaaaactttggtattctatacttgtaagataaataaaacaaatgaaagagggaactaaaaatggaaattaataaagcatacgaaagactattgaaagaagtagaactattacaaaatgatttaatggatattgaagactattcagaagaggtttaccaagctttccagaaagtaattgacgaattagaatatgtgatagaagagggctagaccgatattataggactataccagttgacctccccccgtggttttttgaccgtactttgggggtgggtctgtttgcctaccccgaccctggggtataaatttttttggagctagaaaatttttatatatttagaaagtcaacaccctacatataaagtcaacataagggctcaccctagggctcctatataggctcacctaaatactcccatataaaaaagacccctccccgttgataaggatagggtcttttttatttagctgtctgccttataattggttattaggttcaggttccgccaagcacgacctcggttacattagtgtaatgggcatacccttgtaagtcaccactctccacaatgtagtagtcagtgaactctttacacacactattatcgtaacctattactctccccatagggctcctacctctaccattacactcgaaggtgaaattattaagtctaacttgtgtgttgatagggagcaaaggctcccctcttgaatttagcatgttaatgtggctccttttatttagtattcttaggttaatagcacaaccaagccactaatgacgactaagactacgtaaatttccactaaaaatgagtatatagtaaaaacaatagacaatacagtagtgaatatcgcagaggctatcacccatttagtatttaaactattcgacaaaacaacaataccaacgataaatttaactagagcataacccaagacataaatacctacaatacttagagtaatgagtacagggtgacttataaatccaccccatacattataaaaaatatttagcatatggttactcccctctaagactaacttgttccaccatagtctttgcgaagtatgtccagtatttatggaagtctgcgaagtccaagaaatactccccgacaatctctcctgattgattgcggtaaagcggtactttcgttttctcgtctttatggacttcatactctgtgccatttaatgaaatccatacactacccggagtcacactagttactgttgccttatcgcaacctagtattgggtcacgaagttctggttttgtgaagattgtatccccaaccttcaatttgtttaaccgctctttgtctattaatgttgtttccatttgttctccttccttatacattataaaaaatatttaacatctagttactgccctcaaataaagaacattactacccatccaataagcataaataacaatgttgatacagtagcttttgcaaataccatcaaaatagaatcttctgtatttgtagtagtcttagctgtaataaaactaataaatacatctagcccaattgcctgcgcccatgtaagtgttaacaccccaaatgttggagcaattaacccgttccacaagaacatcgtaacataccctccaataacaagggtcaacaccactagaactaaagtcccaaaaaatttacctaatgcgtttgccaattcgtcttttgtattcttatccatcgttttcctccttaataatagctatatttacctcttgattttcaattttatttagttgtataacattgactactaatattataaatgcagtaatcaggactaatacaatacctccgcatagtacaataacaaaccaaggcatggggttacttaattcatttgtcaactgccaatatacgccgtatgtgagtatataggaagtaagcaaggtaattaacccatagactaccagtgtggcataaattaagtatttcatttatttaccctccattgaatgattaagtaagctattgttcagctcttttaagtagtagtcgcacctaacgtgcacaagacccatacgttcccctgtaatagggttataatgtaatcgtgtaggtactgtgtactcattaggtatagataagtctaattgggtagttaaattgactactctatccggagggtacatccatagaggcttattacagtgccaacatgacccactttgtagtacctcgtattttcgtttaagttgtttttcttcttcccttgttaattggtcgtgatagcactgtgccattacgtatgtctccctccgtttttatatttgttatagtttagtgttaaaccagtcctatatcctctcctagcgtttacaatagttgtttagggtgataataggtagaatacctattatcaccctaagaggcatatagagtacttataggactggtgcttagttaactgttttaagtagcatggaaaatatgcgcttaagtcaacattagttcttttactttagatgatgtcaattgcgatataatgatttgttttggatacattagcaatttcatagtctaagtatggttctagtacttcgttgttacttcctatctttgttctaactgttatggtagcccctgccgtggggtaagtaacgagtacgtccactccgggcttcattaacttaattaaatcttttaacttcatctttgtctcctctttaatagtatatgcttaaatctattttatgtcaactgcttaatttttgtgctcgtagttgcacagatattgtatcaacaatgactgcccactgctcctccgtaaaattgaaatcaaactgtgtatagccttcctcacctgttgtagtaattgcaatgtccccatagtcatcaactgagaaataaatagttgcagtcgcattttcctccggattttgagggagtgtaatagctaattccccttgctctactttcatctatggtgcctccttagctctcttccttctcaatcatcttgatacctgtaaaggcatatacagggagttcttctgtgtaagtgtactgattagctttaaaggtcacttcgtagtaactctccatgccacagtgtaacatgtctacatatctaatttccttacaaggcatagcgtttctctcactcccgcagaagagccagtcttctgtacagtattctactctacctgtgtggatacttctaactgctacgtatggtttttccatctattcttcctcctgtgtaatctcttctaggtcacaagggtgtacatctagtgttactatctttagactatgacgagagtttcctcgtactgcgtaaacaccatctgggtatactttttcaagatatacagtatccccaattgtaaacccatggtcataacgagtgtctccaataaccttaaactgtctttttatcgtatacccatacatgtaagcccttgctaatacatattggttgccttcatcaatccattcagctagcttgtcatctggtgcttcatcgtatgggtcaaaatactcattagctaataagctcaacattgagtcatactttttgattgctcgtgcaacaaaactaggtatctctacttttttagccatctattctcccccctatttaatcataatacatacaaaatgcagaaaaaagctaacatcaacaaaacaacaccccatccagctgttacatatgacatatagaaaacgtatataaggtatattactgctataattgttaataatacaagtatcgtgttaatgagcttttctaaatcaatcattatacaacctcctaatcctcaaaagtataaatctagttcttcttatactcttcctcctatttatatccaaagaactttaagtaactttctgcttctttttctaagtgttcgtttagttcatctagggtaacaacttccccacagtcctcacaagtataagtctgactcttcttatcttctaacagttcaccatcacatacaaggttgatacagtgggttgcccaactccctacatcgtccggtaagtgccccattatacgtcacctacttttacagcaaatgccatgaaacgttcatccattttgcggatttctttctctgtaaaggtagggatatcttttaggtagtttgtaaagtcaggagaccctaatcggtcgatataactgtatccccaaccatctttatcttttgcgataatgatgtagtactcgtcttcttcctcttctaccgtatgacccagtacccatgctttggcaagtttctcatggttttctgggttattagctaaccaaaagtacatcttactagggtagcttcctttgtcaatcatgttaataaacgttaagttctcttctttgcacttgtcaatatattcccctactttataaggaataacaactttttcaggctcatctaaaccatatgctaaggagactgcttttgctatccctgcattgtagcctagagcatgagggttcaacgtaccatcacaccctacttgagtgaaaatctcatcacctaatagattaataaattcattcttatccatttaattccctccttaaaactcaaggctgttttcaataagttctgatagtcggagcatcacctcatgaggtaactctaattttgtactctcctgtgattctgcagagctgacttctaaagtgtactttacttctgttttctcatttacacgggaagccttcttctcaacacatactttataaagtgctgagttattgactgcgataattttttcttgtatatttacactagtattgctatcataagtaatttcatagctcattataaaaacctcctatttatacactggtacagcaaaagcccagtatctttcatcaatttcttttatttcttgttcagtaaatttgttcttacccatattaggcttatttgagaagtatacttcattattgtgggacttgtcaacccaaagataacaatcttcccctttattaccaagaccagtaaacacgatatggtaaagtggctctttctccacctcgtacccatctttcattcgtattaaagtttcaatagggttattcttactttggtctagccaacagtcgaactccgattcatgtgggtagctgttaccatctagcattctaatttgtgtaaaaatagctaggtctaatgcatgtttatttccctcgtaccattccgcaacaaactttggcacaattactttcttaggttcgtctagtttctttgctagcaaaatagccgccttgattgcctcattgtagcactggctccgatttgataactcttgaacgactgggacgtgactgaactttaactcttctaatgcattaatcaattcttgtttattcatttaatttctttcctttctttcaatagcccactggctgaatgcttgtaagacttgcaactgcgcaatttctgtcatgtatctataatttttataaacagggctattccgataatctggttttatagaattggctctcagtctccaaaatagttctataggttcaatatctgttaacgtatatttttcttttaaccaacccaaaacaatttgttgattatcacttagctctacttgggctaccttatcatcagtgtatttgaaccaaattttctcatatgttgtttgtccgcctgtgattgttacaaattcggcgcttgggtgctcattttgaaatttttctagttgttcttcgtaatgtatatccccaacatcaaattctttaaatttaatcattgtactccctcctgttctaaaaaccaatcagtaaatgcttgaataacttgcgcttcctccgttactgataaagagtaatatgcctcttctgttttagggtcttcataggtctccccaatacgttcgagcgcctcgaatagggaatctttactacagtaacctacttttaaccattcaaatacctgtttctgatttttattcagttctggctttttaactgcctctactgcagtcttatacgctatttttaaaaggtctccctcaaaactattagggaaattaatttcaccatttgcttccatatacatataacaaactctgtcaattatttcgttatatctttgtctactcattcactattcctcctcgtcctctacgtcaccccaaccaaagctacagtaggaagagaacacgtctctagctacttcgtctatctcctcattcgtagcattatcaggtacttctactgtctctatttcaccaatacctgcccaagttgtctcaatatatacatttatttttcgcatagtttaatacctaagactacatagtcatctttctgtgcataatctgtgatataagtaacttttgctttaacaaactctcctgtatatgacccacatgtgtactcatttaataaaagaatatctcccacatggtaatgtctatcatttttacgtatttcaaatagttttctaccttccttaactgctttaaagtacgtaggtgcaatcttgaggttatgagtaacttctaatttactaactaaatcaaaaatgatagtgtttaattcgttaccctctacctgatgattcaatttttgtaaatttattgatattacagtatgcctacctcctctactcccataaaggttattctgttggtctctatattcctctgaatcaataactaagtttcttctgttatgcttagtaagtctttccttttctgcttttgcctgtgctagtccatttattgttttagatacttttacttctccatttacaataacttgtactaggtatctgtcgtcctttgttgcaaacttattatccataattagtacctctctttcataatcttaattgaccagttatcgttgttactgaatacccgttctaggtcattcaatgagttggtatttacaatttctttttttagttttctatctgaactaatattaccaaatcgtttaaggaatctttgtttaaagtgggcataacccatgtagtcaaaggtaatagtgtgttctttaccaaatataccccgctctcttagcttaatctctacactctcataagaattatctactttcataaaattatttagaagagtgtgcaaatcaatacaaatagatgcccctgcactaccgcctataagtatatatttagggcactttatatcggggtaacaagggtcatctaattcataccacatattatttacatctaccccataccatacactatttacatctactgagactctttctgtcttaaatggttttatgcaagtatacttcattgtcgctcctccaaatcatctaatacatcttctaatgttgtgacaaccccctgcaaataacccagttcatgccacccatatcctctcttatcttgctctaacaaattattaattctttttgttttacgtttaatttgacgattatatcttctttttagtccctcttcaaaggtcgttaccttttttgcttcctctatatcttttaataattggtctagcccatctccatcagtaccatagctatacactagcgctttctcgtccttataggtagttactcctaatgattggtatacatacttcttactggggacaaatacaagagtaatgggtctgtacaattgaggtagaagacaatcttctgataaccccccaaaatctgttttagaagataccttctctaccacatacctcatatcttccatacttaacgacttaatacataaaatatatctgttaataaccattttctttagctccccctacacccaaaatagttttcgattctctgttggtttaaaagactccaattctcgtgaagtattactttttccatctgttaaaccttctttcactttatatattaaaaaaataaatctagctatctacaaatacattgtatcatcagctagattaaaagtcaacactttatatttaattattttatattacaatagttctttatctaaaattgttttagggatagcccatattgtagtgtaacgaacccctttatgattacctgtaactaatacgaacgttgccgtatctagcttagtaccgagtacagatgctagtagttcatggtcttctttgctaattggtacttcaaaatcaagttccccaagctctaccacaaagttatttgctctaattcccataaagtattcatcattacgttttacatggaatacattcttcgtatgaaaactttgcataacaatatttgcaaaatagctgttatctctagctacaataaatctatctacatagatagcctctttgctgagtagttcttcaatgcagttactcataacatattctcctcctcttctaatagtagctctgatacgtaaatttccatcattagactttgttcaatcccgtctagtaataaatgcatagcacacaagccacacaacatttcatctaaataaaaatcaccacatgtctcctctaatggtacttgacacattaagcactctatcattgtacagccctccttaatttaagttttctctaacttctgttagcacctctcctaatatattaagtccttcccatttactcgtatcacgagagcgtgggtctgattcacgtaaccctatcccccatactttatcaaaaggcgatgcctctgcaaacttagttcctttagggatggacagcataaagttacgtaaactatcattttgtgtgaatttataagtattcccatctaaaacgattgatttacgatgctttacccacaagttttcttcaaaatttttaacttgtctccctaaacgtttagcatcttttgggctctctgtttttaaaattctttttgctgtatcaacatcgttaaaaagcattgctttacgtaccatcatgtagtgctctgctgtcggaaaaataatatcttcccctaaacccttaataggtgcgctgaactgtgatgggtaccactgtgacaagcactctttccctagtttattacgtttacttggggtatgcccccaaaataaaatatatttactcatctaatgttcctcccaatattcatagtagtttcctttatgctcaaaagcaaaatgagggctaggtaacccaccattagcttctatatgctctgggtgctcatagaaataatatggctcctcaccagtagggctaattgctattactggtttatctttaaaaaatagtggtattttatctccatcatttaagtttaatttataggtacttaatggcactcttctatgacattcttccagtgttctatacttatcaaagctaattattttaaggaatcccttagcttttagaggtactaaactatctactgaaacgtcttcttgcttataagtgacaagggcactataaatggttgaggggtttttgtatgccactgaataattaattgaagtgtgcttatggtttgctaaaaatttctctaattccttagataaaccataaggtgtatcgctatcaataacttttactttaatcatgtgttatcctccctatatgcttctctaactgttcctatactttggtctgggtctggtttactaaatggtaagcttgcacgctcttccttactcaatgtttttaagcaagccacatgtactgcgatgacccctgacttagcttccatgctgtccggaagtgtaagtatatagtcattatacagtttacttaacactagccaataacgattgctactacttttcatattagctaaaatcatcattttttcatagtaatcttgccccatacaagaaagtcctcctattgcagattggaggagctcatcttcaagagctaagatagtatttgcgtaccctttcagctccttgttaagcccctctatagcaatctcaaaacattctctttctggagagcctacagttaaatcgttaagtggctcatatgctcttacttctctcccactaggggcttgtcttcgtttacctatacgataagagtctttaaactcatactcggaacgaaaaatttcttcttgactatttctcccagaccttcctccaaaatagcaatcttctactactccaccaagaccattataatgtcctctagttgtccctatgactttagaatgtctaatatgggttagctgacagagctcccctccgttatcagggtcacctacaatagctgtctcacatacaggacagatatatccaaaacacatcactttatctacctccaattaatatacattaagaaaaagttacaattttttcacaaggaatatcatagtatgcctttaaaccataatgttccaacatgtattctttagcataatctacaaggtgctcagggcatttaaatgtgtaagagccactcatcattacaccactattacttaactcttctctcgaagctttagcaaaccacttagcacactctacaggataaccaataacacaccctaaaacttcctcgtcattaaaccctagcttaattgattcattgtatacttctatacttatcttatctgatgctactaggtatatactaccatataacctcgttttataataagagcgttccaaacaacttagttcttcttcttttaatacgattgctacacgatgacctaaattaaaatctaaaataggctttggaaaaacgtactctgctttctcaacaaactccacttagctacctcttttctcattccctaaattatcttaaatgttatattagttagaatggtaagtctctattgtattcttcctcttctggaatatataggatattttcaatcttttcttcaatatgtccaataatctctgtgtgctctttaattttctctttatgattttctctttgcttatttaac

SEQ ID NO: 3 - DNA, 72177 bp, Unknown
  Description of Unknown: Undetermined Bacteriophage F770/05 polynucleotide
ggggtatactgctggtggattcgcagcaggctctagaatgctgtgctctgtcatcgcaatggggttctggaaataatggcattcatcatcaagcctgacatgcaggtagatgttcctggcaaagagcgcatcagtgcgctctctgtccgaggtacggtactcattctggatgggcaggagcatgactttgctcctatctgggatgggggctatctgcctcccgaggcttatatcgggagaactcctttccaggagattaaagtagtggacggggatgtcttcgtccgctacatccatcaggtaaccgtcgaaatcctcgacgctgaacctggcgaagtgaaacctttcaaggtgaccgaagatggtcccgtggagatgccttttgaatactatcgattgggcctcggcactaactccgaaagaagtggcgatggggaagtaccgggaagcactgaatatggccaagaaccttcgggcgaaagcctaccaggaggagagcgagccgattcggatcgaattggaagctgacgcaatggacaagggcgaggtagctgacctcactgcttggcttgaaaaggtcaaggagatccaagaacgctaccctctcccggaggaaccgaaatgactgctgatcaggtattcaaccaagtgctaccggaagcctacaagctgcttccggccagcatgaacagtccagaggccagcgtgatgttgctggccattggcttgcaggagtcccgctttgcttctcgcagacagctggtgaactccatcaacagcgaagggcgtaaagtccttcttcccctcggaccggccaagggctactggcagatggagaagggtggtgccgtcaaggggctgctcaacttctggaagccagccaccaaggaactggtccactcggtctgtaaggccaggggagtccctgccacccaagacgctgtgtgggatgccctggagcatgatgatgtcttggcttgtgccttggctcgtatcctgctctacacggatcctcaccggctgccgcctatcaaggcccaggctgaagcatgggatctctacctgcgacagtggcgtcctggacaaccccatgaagccacatggccggaactgtaccgcaaggcggtaagggtggtgacccaatgactatctcagcccggcagatccggtggattgcggaagtactgctcttcgccatcatcgccctctacgcctacaacaagggcttcgtgaaggcggaatctaaaaccaatgcggagtgggaactccgcatgatgcaggccgaaagggctgcggaagaaaacaaaaaggccctcgaacagagtctgctcgaagccatgaacgaggtaaaaaaagatgctgatgaacaactggctgatcaagcttcccgcattgctgctgctgatgctcagtctcgcagcctgcgggagcaagtcgcccgtctacgtgacgacctcatcgccgacggtgccagagcttccactgagcggcatgcaagcaacgctgcctctgtggtgctcgccgacctgtacggaagctgtgtcagccatcgacaagaactcgcaggagcgcttgaccgaagccatgcggcaggattgacatgccagaagagctacgctattgtgaagtcactggggcacgctcctccccagtagtctccttcgacaccatgcgtaacccccttagactgcggtcttcgggggttttttaatgcctgtcagaaatcaggttcccagaccagtgcaccttcttcgtgtccttcgttctcgtggatacgcttgtgctctgccaggatctgctggtcgatatcccaggaactggggatctctaccgtagtggtattcagcatctccagacgctcggctaccttggtatccaagcgagtacccagaaggattgactgagctctattgaggtcacgctccagaaaggttaactggcgttcacgacgacagatcatgctgaagaaggcagctttcacagaagtgcgtgctcgcttggtactaccgtctttcagggcgagaaaggcaccgtatctctccttagcgagatcacggatatcactggcagcggtgatcttacgaatgcgtacgacatgctccagttccttgagatcatcttcatctactacccagtaggctcggtcagtttctaggaagccaacccaggtagtcttgaagaatctgacctgccttccgttgcgctcagcaaatccacgcacatggtagaaccgggttaccttagagctatcgaacacgggttcgtacttagacatgcttccacacctcctgatccttttccgcaaccattgcgatgtactcttctagtacaaaccgaggatcaacgttgattgactccaggtagtgacggtaggcgtcagcttccatgatcttgtcaccgacagccgtcgcaatgacggtgttgggcatttccaaaacggtagtgattacctcagccatggtttcctccaggcaataaaaaacccgccgaagcgggtttctggttggtttagtaggagtccgggatgccgaatttctccttgtacttgaactcaacccactggaagactcgacctcccaggtggccaccaactgcaatgcagattggcatggtcatccactcgtagagcagatgttggattacagggtacacgtcgtagatcaggtaaccgacgaggatcgctgaggatagctcggagacaacccacacaaatttaggtgggtgtccctttgcaatccttgaagtgaggctgatcaccccactcaatacactgagtgcaatcgcactcagcaccccccagatgttagggtcgcttttccaaggcattggtactctccagcaaagttcaaggccgtatagcagccagttgccatgataaagcaatccttactggaacacacgggtatccatcaggtagttgacttcttgatcatcctacgccagatgtctatcaacagtgccagcggccagaggaacacgtagaacatgaaggtgctgaagaaactgagtgagatgaggatgggtggggtgatgatccgttcgactgtttgcttggaggggactcggaagatgtgaccgatggcgacgaagaaccaagcagcgcccaaagccaagtacaacaagtagtagttcatggtttctcctgtgaaaaaggaaagggggagttgcctcccccgatctgttacttcagcgccttggccaacttgtcagccgcgtcgccaggcatacctagaacggtccagcccttcttcttggctttcttgaagtccaggcaagcctgagctttcgccttgtcgcccttgctatctacgaaggcttgccacagaacctgaccttgttcgaccagggtcagggcagtcttcttatcagccggcaggggcttacccttggccttgaaggtgtcccggacaggctgagccacgggcttggcttccaccttgacggacttcagcttcttggctttgcgggcaggtacacggctcttcgacttcttcacggcctcggcaggcttcggctcagcgaccggcacatccttggtcaacgagggagcttccggttccggcttcttggtttccgtcatgacggtatccaccacctccagaacgtccaccttctccccaactacttcgttgggtttagtcggcagcgagcgagcttccggggcgttcttcggaacagccgtctgcaccttgttcttggtgctcgccggacccttgtgcaccacgatgctggagccacggtgaccggtgatctccacatggtaggcaggttcgctgtgctgacccgccagagcagcccccagcatgcgggaagcttccttgatgtcggtcatgctgcggttggatttcagggccaccatggcttcgtccggcagttcgaagaggatgtggtaggcacggacacgcatcttgttcgcgtcgtaggacggaacggcgatcacgtcttccggtgccaccttggccagcacgcacacgttgccgctgaagctgcccaggtactgacgacgagccacatgcaagccattcgagcactcgttgcggcgatccggatccacgagggactcgttcatgcacaccagagtgccgacggcttgcggtaccttctgcgagtggatgtcacggtaggagaactccttgtgaccgtccgggccgcccttcaacagcagcttgtagatcacgatgcaaccatcatcggcgatggggagatccccacgttcgatgaagcgcataagatcctgcacgctgtgctgacgcttggcggccacagaaccagcccggcgaaggaagttctcgataccgacagtgctgcccttggctttcgactgaacagctgcggtcagttgggtcttgagcttctgggcgtccggtacgatggttccctggtcggtcacggcgatgatggtgtcaccttcgcccacgtcatcatccgggtcttccgactctacgccgtcttcgctgaggttttccaagtccacggaactgaactgcggggcagatgccggtacagcgtgggccaggatttcatccacagccttggccagtgcgggatccttgatggtgaccttttcggccacctcttcccccacatcctgcccagcatccgtgtccggtgcgcagtcaccaggaaccgcgccagcggtgacgggagcgacgggagcagccggctcggatgcggaagctgccgagaagaactctgcgaccttcttcttcgccacgcggaagaaccgcatgatgccaccggacttcttctcggcggcctcgtagacgttgttgatgaccagcaggtcttcggagtagtccacttcaccaccctggctcaggatggggacgtacttatcgacgaatacggcgacacggggatcgccttgggggatacggatctgttcagcagaccctttcacgtacaacgtcagatacctttcgtcgaggacagcacctacgacagttactttgttgctcattggtttctccttcagccacgaatagctgttttcagtagtttgactgtcgaagcgacagtcttcttatcgcgtaaagcagcacggacttctgagatgttcagaagtgtaatcaatggtgcttctgcgattttcttcagcatgccaagcactttcttatcgcccggaacagccttgatcttttccgctatcttgcccaaggctaccttctggtcttcagtgaagaacctgaggtccatagcacacatggtattgagcaagttctcagcatcagctgtttccggctcaggcagcttgaagtcatcacgacattctttgaccgccatcatggtacgaaccaggtctactcggtccgaatcctttgtaacctgaaccagcatgtcgtagcgcagcgagcaagccttgatgaactcaggtttgttcgcctcttccaggaacttttccaggaggaagtcacgagcacttttgatgcccttcttctccatgttggtttcctgggtttcgttgtacacgactgcacccaagttgccatagttcttcagcaggtaggcagagcaagtcttgtccaaaccacgaacacacttacgcacgtagtagtcgctcttggtgttgaggcgtacgtagtaagctggattctccacccgagctacgttctcagtacgtgccatctccagggagaatatgccgttgctatgacaagccgagagcatcggataacccttcttctttggcttggacacgactggggcagcgccggtcttcgagtcatactcgattacttcagcttccttggtcaggtccaatacttcccagcccttcagagtactcagggctttcctggcttcctccacctttttcacgctacgcggaaccacgtaagcgatgagtgagtcgtcagcattgtaaccacctacccactcgtcgagatcctccacacggctatggatgtcacgacggctgtgagtcaggacaatacagcggcggaacagcggcacataggacatcggattcttcgaccagtacgaaaccaacggatacccattgtgggtgttgtagttccgaacagaatccccgttgtgcaggtgacgaccagcgccgtaccagatcagccgagtggggcacagcccttcttcctggattagaggcaacagcttggaaaccaggtgcttctggccccacttgcgtactgccagggcctgccaggaatccttccggaacttcgtgaggttctcgaagctggtacgatcgtagtggctggggtcagatgtcatcccaaccttcttcaccagccggatgagcgaagggtacagggtgtttccttggtttcgcggctgctttccgatgagggaaagctgttgcagcagagtcttgaagttctccttttcactccggctattcgaatggtacagttggctcaagccaacatcttccatggtagacatgagtcccttatgggtcagaccagaccctttcatggaacttacgagcacgcgattagccgttacttcttcaggccgcagcatactatctgccctggcttgcaccagttcttcacaggacttcgccaggatgtcactgcgtaccttgttgatattccgcgttgcacggaggaacttgttgagcagctgaagaagagtcttgcgggtgtggtcttccatggacagcgcttcccgagacggtgtgatcgacaccgagttcggtttggcttggagcaccagcacgttgacgttgcccggtagagagttcacgaacttgtgcacagggtcgtatacctcggcgatgaattcatcccgctctacgggatagatgacatcgccgtaacggacacagatgatgtggccgttgtattcgagcacctgttcggtagcgatggaccagtcttcggtcacctgggagaagggcagggtgggcagcttcaccccgttgaagttggccagcatctcggcgttggccactatacggcgaatcagcgtaccgaatcgacgtacgtcttcgttcttgatgttgatccgtacttccagaccggtctggtcggtagggatatcggtcaccaccggggtgatggcaggacggccaccgttctggatggaagccttctgcatgcggtagacgttggttttcccttcatggtgaatggtcacctggaagttgtccacgtaggcgaagggagacttgcaccccaaaccaaagccgccagtctgggagccgtcgtgcttcttggtggagccgccgtagacgccgtagatcgtgccaacgtcgtcgggatggatccctgggccgaagtcacggatgacgaattcgtcgtccttgagggtgatctcgaccggggtctctttctcgatgccgaccatcttgtgggcatcgtaggcgttgcagagagtttcacggacgacggcaaggatcttgtccgtgtacagggaactcgacagaacttggaagaaggccgggtcatcactgatgcccatggaaattgcttgcttgccgcctatcacaacgtgagtggcgtagtctttctgatgagttacctgcatggattactccttggacttggcgcgtttagcgcgacgtttctgattggtgaggtgagtgaccatctccaggtgagcggggttgcaacacaaccgttgtccgcagagatggtcgatctgtttcttgcctggcacgtagccgaagtagttggtgaacatgacgatgtggacggccactgtctgaccgtccaggctcatccgcccgtaaccaccacccctgcccgtacctgaatccgggccttgccagaggtggcaggggctgggcttgttgtcgaggacgaagcccgtgtcttcgactttgcagcgggcttcgattcgctcccggatttctttcctgcgtccttcgaacacttggcttcccctcggataaaggccatgagtttcttcttcgacaaggttccgttgaacttacggaagctgtcgtactcttgcatggtcacctgctcgtacccttcaggaacaggcagttgaccgatagtccaggtgtgggtcatgcgtgtctcacggttgacgaagaaataccgtccgttgacaggcgcatgacccaactttcctggagtccaatcagctttcagtttggctttcttcgccatgattactccttatgcagcacgtacatgcctttgatgtcggtgcccaagatgtaacccttgggcactgttggtttcccatagacagccttgccggaagcgatagcagcctcagcttcttcgatacctccgaagtgcttgatcatatggttgaaggaagcccagtaggacttccggtcagttagcgagcagggttttcgagacaacgtagtgacccccgtgttcggtgataagggagtccagggtgctccaactcatggctttcacattgcccatggccagcactgtcatcccctcgggttcatcatgatcatctcggaacagcacgagatgaactccatgtgtagcgatcatttcggcacaacgaacacaaggtgccctggtgatccaaaggacagagttgtccagtggtacaccagagcgggacgcccaagccaagatgttgtgctcggcgtggatcaccccgtagggagtggttttgaagcgggtctcttcccgaaggtactcgccgttctcgcaacagttgtcggttccaggcatggtgccgttccacccagtgaagagggcaccggtcgtagtgaccagcacccctccaacttgatggcgttcagctacactctgcttggccgcatttgtcgctatcgacatgtacagtctcctgtacttcatcgacctcgggtctggggctttcagcactgttgatacctctcgcaaagtcgcaggcagcccaaaggccgccgcattcatggacgagcacaccgtccttacgcacggctattacgccttgcgacacggtgatctcgtggtcgtttaccaagcaggtacttgtcacgcagatttctccttcagtgcagcagcatgctcacggcactgttcaatgagacgttccttggtgatggggtagtccaaagtgcaggcttcacgccagctgggccagaagatgtccaggttggcacccagaggaacccgcttgtcattgatcttggggtcttcctgccacgccatgcacttgcagagcgtgttgttgacccacacagtgacatcaggatcgtctggccacatcacgtagatcgcatcgtggatcagagagatgatctctaccttcagcttgtaggggctggccagtagcagcttgcggaattccacagcagcacggttggtcagtagaccccaggactggccggacaccgcattacccgcactgcgggattcagcagcggcctccttgggagtcgccttcaagccaagaatggtggaccccaacagcggcgttctcagccgcaggttgaaggccagttccacgtagcccgtcttggttgctttgtcgatctcaccagccacccactcattgcttacgcgatagagcttgttgtagttggtttcgatctcctgggcttcttcatccgagaaacctacctgccgcaccagacccatccaactgcccccatactggagcaggaagtgtggagtcttggctttgcttcgcaggtctgggtagaccttctggatcgagttgatggagtcaaccgtgtctatgatcccatcacacttgtacggccagaacgcaaaggtacgcatcgagtggccatcgtagccatcggtgtacaccttgattttgttcgggtcttgagtgagcagggcgttgatccggtcttccagtgcagcgaagtccgcccctccgaagaggaagccggggggtgcacagaagagagacttcaccagcttgccataggtcgagccagccggaaggttttgcaggttgggatcggatgaggacagccgcccagagatggttcctccaaggttgaaggagccatgtaggtacatcattccgtccgccttcattcgacccgccttgaaggctggcatgaaagcagagatgaccttctctacggcacccaagtccatcagagcctggatgagatccttgtacggttccgccttgatgtggttcaacagcttcttcagcgtacctccactggtggagggttgcttggtcgccgtcacgtccagtacaggaaggtcgagaacttcatgcagcagacgtgctacttgcgggccagagttggggttgaaccgaatgtgcgaaaacttgctcagcggatgctggatcgtcttcagcttggcattggccttctccatctcactggtttggatcagcacctctaccttggcgaccgctggatggctcatcacagtattgtggtagccgtcccgcagattgtttagttcagtattgacctctgtgatcttccgaggattcataggcatgcccacgagttccatttggatgatcaggtccaagctgtccttgaacaggccatggtatagagcgtcctgctggtcttgcaccatgatggggtaatacttgttcttcacccatacggttgtcaccgcatccaccgcgttgtaattcatgaggtcgtccagcggaatcagccggatgtccttgatatcgtcctgtgcccagttgcccgcatgttcctgccccaggtctttcagggagtagctgacatcagcggttgagttcagtgcgaggtacgcgatgatcttggtgtcgtccatccgtggagtcatgatctccaagccacgatgcatgccctctttatcgaggtcatgctccatgaagagggtgtagatcagaaccttcacgtcatggtttgcacggtggtatatgattcgcccagggtactcggtgaagaaccacttgagcacttcccgcatctctgcgttcggctcgtagtaaccgtggtgcttgttctcgtcctggatcatctccctgtagtcacactggatctgtacagcatcatgctcgttccaggcgaagccaatggtggcaatgccggagtcgaacatgctgaggctgaagccctcgatgtcacaggatatctccggcttgtccatgagcctggccagtgcttccttggcttggcttacgtggcctcggtagatgtaggtgacatcgtgcagcaggtcagacccaacgggccgatacaccccatgggcatggtcaacgatggctttgaagccacggctgagcctgtgcatctgcccaggatcgaacagcagcacctgatggttcacacccggagtcaccaggtacccaggatcgtaaccagcaggtggcgacagattgccgaagtccgcgtctgtcttccgcttggtccattccttgaagtacttggagtcagccacgtaggcatactggactccgagatcccgcagtagctggtcgcgatccttgatgcactccttgatcgccttggcagataccttcttgccctcgtaatccagagagatcacgatgacattcttgcggggtacaccaagcccttccagctgcttgatgtaggtggattcagcggctgaccgactcaccgctgcctccttgatcaggatagccacagggtagctatcctgttcttcccaggtgatgtacttcatcacagtcctcctagtacaaggttaatcccaacacgggtgcagagcttatcccaacccgcttggtttgaacctatgggactttcggtcgggaattccaccccttccaccggcaagccaaagtgctcatagaccctcttcagaggttcccgtaaaccacttgggaacatcttgaggtactccgacggttcgtcggacttgttgagcacctggctgatgaacgtgagtacagagtcacgctcgtctatcagcaccgggtcgtactcggacagaagactgtctacgagtactcggttgccgcgactcagccggggaaagtagcggaaattgggcttttctccaggtatcatgaagttacgaccacggtggcagaacgcacggataccatcgccgcgagctacagcatccgcgatgatcagttcgttcaacttggcttgaaaagccttcctcactggaacatagaggaaaccatccaagcagtccttcactgcccttttgaagatcaggaactccggggttctcgcttgcattacatgtcccctgtcatgaccacccgtctacgtgctcggctgaagccaacgtaaagaaggcgtgccagtgcattcgggcggtgtaccttgccacagatgttgtccaggtcgatgaacaccgtatcgtaggtggaaccctgcgacttgttcacggtgcacgagaaggcaggccgtaggtctacccagttctggtcgatcagctggaggatcttgtaatcctcttctttccgagccagcttctcccggtccttgcggtccttgagggacttgggcaggaagaagctgctgttgtggtgcatcagcttcacgaggtagccgtccacgtcaaactctctggttggccgaatgtcttcgatcaccacctcggatccgttggacagctgggcatgcttgttgatgacggcttcgttcaccagcatcttctgaccgatctgcggatcactggaaccgagcagtaacttcgagaagtgcttgttgtactcggtcacacaggcattggtgtaagccaataccttggtgttaccgtgcacttccgggtgctggaaggcgtcttctgccatctctacgaacttgtcccgtggtacatggatcagctggtcaccgtccaactggatcttcggccattcgcccgtcttcaccgtgtggcggaaagcgttgcagaggtccaacaggggaccactgttctgccgcttgacctcgataagttccaccacaatgtccttcatggcgaaggcaggcatgatgttggtaccgaccggagtcagctggcagtcgtcgccgacgaagatgaatttacagcagtcagttctgtcgaagcagaactggagcaacgcagggtctatgtaactggcttcgtccaccacgatcaggcaccggtacggtagctcgaagcgggagatgggcatcagttcgctcttgcccgtcttgtagtcggtgcggagacgaaggcccaatgcccggtgaatggtcttgacctcgtggttgaactccttcatggccaccgccagagcctcacatgcttggtttgtggtggctgtcagcaggggttcgaacggctcgaagttgtcgtccagggtagacagggcgcgatccagagtctccatttcgtcgaggattcgtcgaatcagagtggacttgccagttcctgaccagcccttgaggaccattacctgggcatcggggttggagtagaagttgatgaaggtctgaaacccggcttcctggcctggcgtcagtacgaagggagcaggcttgtctactccttcggatcgaacatgatcacttgcccgtacggggctttccagttcgatttcctgctgtacgggtgaatcaaccatagaatcggtactcctgggttgtcgttgtagtggtggaactccccatcagagaacaccaccaatgcgtgaggtttgttctctgcggcccactgcatcacaggggcaatgcaggtaccaccccggcccttcaactccatgttcatgagggcattgaggttggggaccgtatccaccgaacggatggaagcgtcgaactggatgatatccagctgtgttggtttcagcgtgacgaagatgttggcgatctccgacaggtagcggcggatctcttcgttgctgaccgatgccgacaggtccattgcgatggcaatccgcaggagtgccttaccgcgacgtgagggcaggtagtacctgttgatcagccggcgattgggacgtgcccaagtgaatccaccacgcttgaccacctggaagaactgacgcagcaggtgaggcaggggcagcttcgggaacatcaggctgtcgatgaacacctgcacttcccctgggattgagccagggttgccattggcacgggcagcggtagcagcactgaggatcaggtcgttgatggccccctggatctccgtctcagacatgggggtaccatcgtccttggccggagcaggccgggaaatgtcatcgaatggcaccgggttaccgctgccactgtttccctgagtagacgaggacaagccaccaccaccttgagtttgctgctcctggtacaggtcagcgtagacatcttccgtggacatgttggcgtacttgggatcacacacccaattgcacttggcaccagtcctgtagtccgtccaggaaataggaccgtacccacaagccaacaagttgttgttgatcacgtggtccccagcgatgttgtacagcatgggatcacggtcacccatacggaccttaccgatgtgatgccgccagacgtgttcgatctcatggagaatcacggtcttgcggctcatctcgtccagggacatgaagaacttggggtcgatgaacatggtgatgccgtcgatagcagcagtgcccatgccctcttcccacacgtacttcagacccatcatgatgttggcgtagaaactcaccttggagtctccgatgatgcgaatcttcgccttggaaagggcgatgtcttcagcagaacgatcagtcattactcacctccgatgatggccatcgccttagcgaatttgcaccactcaacttgattgtgggtttcaggtattaaggaaggaacagccagagactgggccacgaaaacttcttcttcatcaaaaatccagtgaccatttagtggattggttattcttattagctccaccacttcattaattgaagctgcggtaccacctagtcgagagtaactctggttgtattggctttcactattacggcagtgacccacataaagaccaggtgttacatatgagccgtctgggggcttaacggtaactacgtacggacaaaattcagatgctagtttttctagtactgatttagtaccgaacttgatccccttctggatacctttttcatagatgctaactctccagccttcgaaatctccagtgagtagtcgattgggggagtcgctgtttgcatactcgtcaactattgcttgacctgtgaggtcttcttgacgaaccataaaaagttcccatcgaccactcactggattctcctttagaacatgttcaggttcttcttcacccactccgaaatacgcgggttctgaatcagactcttgttacgctggcaagccatacgcagagtgatcaccatgtggtccgggttgaaccggtcgaggaagatcaggatcttctcgatgttgtccaccttggcgttatccgccagcatcgaacacatggcgaacatcagacccggctcatccttcggcacgtagatcgtgctcggggaagtcaggatctcttccaggctcggcaggcgaccgaagtaggccaggaacgccttgaagtcggtggccacggtaccaatgatgcccatggcagcagcgaggttcagcatgtcgtccagggcacgagggtcttgctccggggacatcttcaggaaccacttcgagaagtcttcccaggtacgcggacacgcatagacccgaccgctgttctgcggatcgaaggtgtagaacgcacggggactgaactccaggaatgcttgtaccttggtggcgatgtccagcttgggagccacgacttgaagccaacgcttcaggtcattccgaaccacgatgtggtgcagacgactgatgagggccgatgacatcgggttgacgatggcaccgtcggtttcgaggttaccggcacccattaccaggcacttcggatggagatcctcgttaccgatctggcgatccaagatcagcttgtaggccgccgcttgacgatcgtcatccgcactggtcagttcgtcgaggaacagaagccagccggcgaagggttctttggtttcggggttgacgggcaactcgtctccgaccagggggaactgctcgaatacctggaacttggcacgctcgccggagaggttcggcagaccattgaggtcagccgggtccatctgggtgagacgcaggtcgatgagcttcaggttgttttccttggcgatctgccgggccactgccgacttaccgatgcccggcgaaccgtggatcattggcttgaggccagctcgcaggaagctctcggcgatgaacttggcgtcgaaaatggatacttcttgttcctgggggaagtgcatagtgaactcctaaacgattgatttgattggtttaagccttggctactacgtctttcggtgttcccggaaagcgtgcagccgaccgctgacatgccagcactcgggcttggccgtgttgttgaccctggtgtagctgccacgagcgtcgaaggtcagcatggagtagccttcgggacgctcggtgacagtgaagatcaccacgcgagaaccatcacgagtgacgtagttcccagggcggtcgatgagaacaggtaggtcttgcagcttgctcatttcagcctcccggtgctgaagtcgagggtacgggcgaactccttcttgcctgcttgcggcttggagtcttcgcctgcgttgatgtagtactggtggatcaaggtattgatcaaccgcaccccgatgttgctatcgggatactggcgaccgatctccttgatcagccatttctcggccttcttgtggtcttccttcgggaagagagagcggtagttcgcccacagttccgactccttgaggtactggaccatcgcctccagagtcggtttctccaggttgtagaccaagccagtgcgaccgatgaactcggtcttgacgccgcacttcagcagttcggtggcgtccatgttctcctggccattgaaggcaccggcgaagatgaacagggaacgctcgacgcacaccgtgttgtacttgccgtagtcgccgaaggtctgggtggtactgccctccagcacacgcaggaactcgttctgcacaccgatgctgatctcgttggcatggctgtcgttggaattaccggagaggaacagcttgtccatctcgtcgcagaatacgacgttggggacattgccgagggtagccagtggggccagtgccttgctcaggctcaggccggagtagccttccttggtcagcgatgcacagttgacctcggtcatgggcagcatgatgtccaggcgattgcactggtccatgatgttgaaggacttgcccgaaccagaagggccggtcaaccagaagtgaggacgaatctcgccttcggacgctttgaagatgagaaggatcttgccgatccgctcgattgttttttcattggcttgggacactggttagtctcctttaaacgggaatattaataaatctgggaatgcataaccccaaatattactcggaaggggtccactcacctacaaagagtagaaaggtattgtgataccccatcatggctcgcatgaagtcatgatgactgcccccaggaagcagatgtcttgcttcttcgagggcttcttttaaggaactgtgggttgggtagagcttctgctccaccggactgagatcgctgaactgcatgttttcccctacttaataccgtacttgcaaagatctttaaaacctttccaagctgtcttgataattttggttactgtcaggccaaatactattggcaatgcaatgggccacaatatccctagggttactgaacgatcagccttgtcgtcgtagtcgtcgtacagtacaaagtcgaaaagaccagctgctactatagcggttgcaaagtaggccactatcattgctatggcatcacctgacatagtgaaactccttggtttaatacacacagtagaatgccgacagttactcagtgactgcatcctgtgcagtttggaaactcggcattctctttatgtactaatagtctgactagactgtctcgccttatgcgacgctatgcgcagggagttgtttaaaggattaacgctaatgcatgtctcttgctcctaaaccaataaaagaatgaacaaacaggacaagagcgtacggagtacgctaatgaataacctgttctcctgtgaggtacatcatcccatctgtaccgaagcggcccgccagccaacctcggaagaacccatgaatcaaagggttgtcagcgtagtctccgagacggctacgcttactcgccagttcttcaggggtgatgacttaccccggcgaaggaccacacacagtggcggtactcttcttcaaattcctttcgcagttcgtcgctgatcacttcagcatagaacgcaggttgttcagcagtgcctcgccacccttcagggactggacgtacaagcacgcatcgtagacggtttcgtccaaaccatgcttctggacgtgttccttgccgaagccaagtgcatccagtacctcggccagcttattgcccatctgggtgaccacggcatccttcaggacggcagtagtctgctcgtcttgcccctgcccctgtacgtcgggatgcacgatagtctggttttgacgcagttcgaagaactccttatccagttcttccaaccgcttcacgtaactctgtacgtgcctttccgtggtatcgatctcttcgctgagaatagaccgtttgttgtgaagcacggtgatttttcggcggaggccatccagtacatttttcaggctactgagttcatgctcgatacgttcttcgctcaacattatttgttcaccccgtagagttggaagtggtcgttcagttcggtgtagcggtagccatgcttgtcgatcactgcaatctcgaaacaggcatggccgcaccagttgtagtgggtttcggtgccgatctcttcgatcaccaccttcttccgtacacgctcacccggctcaccgggcagcatgaccagggtatctcctggcttgatcttggtagaccacagaacatggtcaccggtaaattgggctttcaccagttccttcgctccagcggtaagctgtacgcaaaggtgctcctgccccttcacgtatacggctatgggtatgttgtggctggagcgtcctaccttgataccaacacgttggttggccacgatgaagccatgacggacatagacgaacttgcccttcagtgcggcgtacagcttgcccacggagataccggtcatgaaggcgatctgaagctgaccgaggtcgttgtggtaggcgaactgaaccagcttgccgtctgccaggaagtacaggcagcggtcgatgggaacatcgatggggttaccacgctgaaaccaggtgatcttctccatcacttcttctccttcaccagacggcgatgagccttcgacaggttctcgcaggaacggagcaggaggtgcggattgttgctcttctggaagttggagtactcccgcatgacggcatgaaccagggtgtccatggtcagttcagcatcgctacggcgctgcttgcgaaccttgtccttgagccgctcgatttccttcatggcttcggcgagcttcttctccaggccagtatccaccggctcgaagactgtctcttccgggatgatctcgggagttccttccggctccacggggaacggcttggtgagtttggcgatcttcttgtcgcgtgcttcgatggccgccttcagcttgctgatctgggtttgcaggcgataattatcgctctgagcacgcgagtagatccgacggtagttcttggcttccgagagtgttgcgtctagcttgttgttcagcacactgatgacctgatctttgcgttgaactttctgatcacagtagctggtcagatgggacatggcttcattgaaacgcttgcgggaaacgaatgggatcatcggagttctccatctagatagacctgaacgtacttaccgttcaaggtatatttgagttgtaacgtgctgccctcgtaagcatcatgagagatgtaacgcaccctttcatagaggtagtacatgaggtcagcgactgcgaagttgtcagggtattttctacgggctgccctgtacccaacacgaacccaatccattgcaaggacagatgcttggtgtaacacactccttgctactggtttgttgcggtactgactgtctctctccatggcttcttcgacaagcttgcggagcatctcaaggaactcttcctcttcgtcccccagcttgaaccgcttgcctacgttgtcgatgagaaagtcgttctccattatgaaattggcgatgtcgtagtacatcacatgctccggtcgttcctccgcctgacggaatctactccaccaagaggtctccccccggagccaccacattgcaccaaaggcccgtaattccgcttccaagccctcggtgctgtcgatgtgctcaaacgagtcatgaatgactgtcatgggatctccaggctcaaaggtgtgcatgccatccatcagccagccaccatcctcgaaagtgaaattacggacctgcatggcttacgcccttacacgagcgttcagcttctggagttcctcgtagatgccgtagcccaggaaccagaaaccgaaggtcatgccgatacccacggcggcgcccagcatcacgaacagggcgaccaggccgttgtagacggtcagcgaggcgactgccacgactacgaagaccagcacggcgacgatccaagccatggtatccaggaacttcaggtaagacttacgcatggtattactccttcttcaattgaatgaactcactggaaatcagcgaaaatgcaaaaagcgtacggagtacgctcaaccccgactcttcacaatgcagtctccatgtgcgtagaagagatcacggtagaacttgggagaccctccgtacttccgtgccctctcttccgcactgggtactagcactattggcttaccacagtacttgcatgctctgtgcttactcatggtttctaagctcccctcaaaaaaataagcgcccgatcccatttctgggatcaggcaaattcgggttcatggagcgtctggaagacgccccataagctcaagacagcgcatactcgctttcacggatcagttcagacagattgtggatcgaccggtcgtagctgacatggcttccagtgatctggtgaacgatgtcgtcgaggatgttgctgtcggccagttcggcgaagatgttgatgtagtgctggcgcatctcgttgcagaagttcgggtggcacttgaactcatcatgcacggtgaccagttcgaagggctcgtgaacccgcatggtgtcccacagggcacacagagcctccaggtggtcagtctccagctgatgtacgttggtagcgttgatgtggttgaagatcactgcatcgaccatgttggtgcggtcgtacaggtcttcgtagacggccagcttggcgtccagggtttcaccggcttcacactcaccagagtgacgatccatcagttcagcccaaaccaactgcattaccttggtgatggcttcacggtcgtagttgcagcgacggtgcatggaacgcagcacataggcgtcgatggagtggatgacgttggcagcattcttcacagcacgctctacaccgcagtcctgcttgtagatgtactcgaagcttgccccttccatctcgtccacttccacccgagtctcgaacacgtctaccgacttgacgatggagtggaagttgtccggcagcacccaggagtgcttcatggcatagggctgccaagtgttgatcaggtcatcccgcatctcgttggcgatgggagctaccatctccacgccctggtagaaagcttccagttcaggagtgtcttcaccgaacaggttcttcggctcagccttcgaaccgtagaagtgagtcatggttgcagtcttgatgtctgaccgcttgatctcccctaccgactcacccaggtgggtagaggcagcagtggtgaccaggctgtatgcatcctgacggaagccggtgttgatgaggttggtagcttgagcaccagactcacagccacccagggcggacatgatctgcatgccggagcagcaggcatccagccctaccaggtgaccaacaggctcaccacgctgggcagcacggatggccatgacagccttgaggtactgaggacgggtcttctcgttgcactccagattctccagatcgtcgaagttgtcgtagcaccattggatacgttgttcgaagagccacttgtcatggcccatttggtttgcagcgtcgatcagaaggtattcgaaagcggtgtaaggggtcatggtttagttcccattaaacgaaggttgattggaatcaaagaccgtagatggtcaacagtgcttgaagttctttcggtatttcctcggtataagctacaggcatgtacttattgaaagggttgtccttcctgaagtgaaaccagtaagcagtatttctcctctttgcggtcattctgagaagcactaaatcccgcttatctggtcctttcagaccagcttggtaatatgcttggtccgatacaaccctattcatctcatccgtgaacaggtgccactcaccattgtgaagccatgcagctacattcattggttagtaccctgcaagtagtgcaatagcactgggttctttaatcatttcatctgatgcttccttgccatatgcacgtccgtaggtggggtagtacttccacataagccagtactgaccatcatagaaggcggtcttcctcctggtgaacacaacaggttctttttctttccggtagagagtagcgagaccctctgcaactctgtctacggtaccgtccaaagccgggacagcatcatcagcaaacactctccaattgtcgccgtctttccaaaccaccagttccatttacttgtcctcttcattactgtgaatagaagtttcactctagcagttggtctaaactccagatgaccagcattgctctgaggtctgctggcagaagattcacgtcttctatcgcatccttatcagtcatacccatccaccaccatctgactccattcagcttgtagcaggtacacgctgctgcttcttttgggctgtaggccatcattgacgcagcttgcacaagctcaagcaatccgccgtacttgacgaacttccatgtatcgtcttctttgtagaaggcatagtgactcacttgcttgctccttcacttgatcttcaagtgctccggtacaccagtgactaccttcttgttggccaagtcgagcatggccttcttgtaaggggatccctgggtgctgatgtggtagccctgtgcatacacacggccacgcttgtcgtacttgtgcaggaggtagaaccgattgccttgctgaaccatgagcttatacatctcatgggactcagagacgaatctgtaccagtcgtctttcttgtcctgcgtatccaagtacttgtgggactcttcttctacggtgctcaagaactcagtgttcaggcacagctcaacagcgttcatcttgtccagcacatcgagacagatgtcttcgttgtgatggttgttgttcaggatcagggattccttctccagtgtgagatgaagcttcgacttgttcccagtgagcttggatggtttgcacaccataggaggaaggtacatagctcgctcaacagcatgttgaagcttctccggtagttgaatattagagatgaccttgtacgtaccgtacttgtacacctgctcaatgtcgtacacgtcaagctctgccagcactgcaaccatctcagcgatggtcttgatgctgtcagccttgtcgtcgaagccaagtacaccagctagcttggctgtgaagctgatgaacatgtccggtacctgacagtacgcagacgctacgatgatctcgaacacaatgtgctcaaggtccaggttacgaacagtctccatacgaaggttcttggagttgtagctgtactcagtggtgcgatactcctccagtagtgctattccccgctccatcagtgcaggaaggtcttcgtcaccgcgaatgaactcacggatgtacccgtcaatgtgcgcccgagcaaagcggtactcattggcgcgttgcatatcttcgggcagcatgtgggtaatggtcatggaacgattccttaatcgaacagaagtgattgggcacggatctctggcggtactagtttctctgcaacaggattgaagtcactgctgaagacgaaccacctgccattgtgcttggtatagagtttcttgaacggatcagtgtagctcttgagtctactcatcatcagaccactagctacattggaaaggtctttacggaatacctcttctgtcaaaccatcaaagatgtacagacaggactctcctttacgcagagagtcagatatcagcatcgtattgaacttgcgggccatgttttgctccgcttcccgtatgcccaccattgtaaacatgtccttgttatgcgcattgatcctcatcgccaactacctccattgcactagagtgaagccatcccattagggacggctccagatggttacgttgccggggagacgagccaagatgtccttgatcagccaccaaggctcgttctgtcccggctgctccaggtggtactggtgggttgggttctcctgtgcccgccacatcagctgagtggtgctggtgctgacgcaacccaggtcagtgggatcacggtagtgacgcttgtcctggaacacacctaccttggattggcagcggcacccgaagatgccaccagcccctccattctcggcgatgtactgccccacgctggtctgaataccagcatcgtggaagcgggctaccagttcagcagccataccagcagtcatgactactgccccggtggaggtgagggtgctgttgctcagcacgatgaagtgatcagccttgtcgaaggcttcccacatgttccctactacgaactgtggcattacaggagatcccccatgcggatgattccatcacagcagtcaggggactgcttggtcaggacgatgtggttgttgacgtggctgtactggaacatccagcggtgcccgtcatcttggtcgatgacggtcaactgcttgagcaggttcttcagcttcacttcacgcagtgcgtcaatgagagtgtctccgtccgaaacgaacatgccgttgtcgtcacggatcactacacgcttcaggtaggtgcgggtcatcattcatttccccaatacttcgtggttggtttgagccatggtttccatgcctcgctgaaatagcagttgtcgggtgcagcctgaaacagcggagctatgtcactgtcatggaagccagccagaccacagccaatgcgggtcacctggaagctcatgtagctgtgctccttggcgaagtccatgaaccgttgtacggccttggctacgtcactgatgtgacaggtgaccagcctcccaccgtgggccctgtacttggtgggcagggcataggacatgccagtcggcccttcccctacgcccatttctgcacccttgttgtttcgtgcatagagggcagcaccagcaccatggataccagcagtgttgctaccgaacacgaaaatcatgtgattggtttccatcagttgaatcctccgaacttgttgcgggggcctttgcccaggtgattggtttcatggttacgcacaggcatctcccacttggggcgacgcttggacttcttcactggcttgggaatctggtccagcatgtgggccatcacccgttcttccagtgcggtcatgtctatgtacaccatgtcgatcttcctgtcggaatacttgcgcacttccagtagcttgttcaggtagtcacggtccacgaccagacgcccagttacagtacccccggtgggtgttttgaggtcggttggcatatcggttctccagccggaaactgccgattccagacttttacttcatagtcagtaaaccagctgagtttcattggtttgatcggaacggatggctgggacagtctcttcaactgacccaaacctatactctaaaaaaccagcccacaccctactcaggatcgagttagggtgtgggcggacgcttttacaggtccagctgaagttcggacttgtcacgcacgacgcggaaggacaggatcaggcgcgagcgcaggttctcgatgcgcttggccagatccttgtcgtccttggcttcggccaggtactcgtgcagctgtgcttcgacggcttcgctcaggcgcagcggaatgccattgcccaggcgaaccggatcaccgccacgggtgccgatggagatgttgatgaagctggcagcacgggtgtcgtcggactgagcagcggtgttggtacgagcgttggatttcttgagtgccatgattcaggttccttgtaaggagaggtggtagatacagatcagaagtggttcggctcacatgagccatcacacaggcgtagcctgctcttgctcttacacccagcggggttcgtcggacaggtcgttgtcccagtcagcccagtggttcagcacgtcttcttcggtgaccgcagacataccaatggcatgcagttcacgagcaacgctctcagcgtccaggcattcacgatagccacggtcgaggatggaggtagctttgcgggtgatcagaacgatcatgatgaaattcctaagtaaacagtgagttgagatggtttggattaccaccccatggccgtaggccatgagtacttacagcagaccaaccaagttgaagaagatgcacactgccccgatcagggcgaacatcccggagaaggtcagtacgtgcatcacaaggatgtcgatcaccagacccatccaggtctgttgcatggtgtagttgttgctggaccacttcatgtagccgttcaggacggccacagacgaagcgatgtaaaggcatagcaggttgaggatctctacgtcagtcacagcagacctccagcgaggaagatgaagaggggaccacagcctgcgaacagcaggcccaggccacagacagccattacccatgcgtggattctccgcatctccaggtcatggcgtcgggagatactcagtggaaacctgagcatctcgttgatcacccattgcctgtgcaggccgatgaccagcatggacagacctacagcgaacagcaggaacatgatgaggatgatcacaggtaagcccccacgacgaagaagaggtaggcacacacccaggtagccactccgtacaggacggtagctaccgcagcggtaccacggttaccacgaccagtctcacaccgtacccaggtctccgcagcccatacgagcatgcggaggaaggacaacacagtgggaacgaccagcagcagtacggcgatgacggccaacagttgaacgatggtcatgatggactccttggttttactaggcgacgtggaagaggaagttgattgcagtgacccagacagctgcccagaacacgttccagacaagacctactacggcagctaccttctctgccccaggcagtacgaacagtgcaccgaagcaggtcagagaggccaggcacttgaccaggaacaggtagccacagaacacgatgagtacgatgcaagcgatagtgagcatgggttagatctccagggtaaagggtttggttttgagacggttggtacaggcaccaggaaggtctttgttgacctctgtccaatgccagtgcttgaggttgagccgacgacgctgaaggatcgcagtcttcaggctcttggcggtgtactcatcaccacacatgactacgtgggtgagtacagtgttcgggcagtccatgttgaacaaggtcatccgtacacggaagccagtcagctttccattggtagggatgatcttgatgtcgaagagacggccagtgagattaaggttggtgctcataggtgttccttttgatgaggtcgtagtaggcccaggcatagaactgaacccagttctcttctgagtcgtccaagcccactcgttccagtaagccgagtacagagtcagatccgcggaagtgcagtttctcccacaaccagttcttgaaggaccggtactcatcccaagtgattggagggccaactaccactccatttgccaggtcactcaggacgaaacacatgtaggtttcccctctgttggcttgttgccattccaggccaatcttgatcagttcagcaatggttctcatggatcagatcctcacgtcagcaaagccaatggggtcagcgggacagccacgctcattgcagaagtctgcgaaggcctggtccagcatgttccagacacgctggaactcttccagggattgtatgggactgaagccatgctggatcaacaggaacagacactggtcatactggaaatcccttgcccagcactggcacgcgatgtcataaacggtgatattacggacacgtttgatacgagcgtacttgtacatcatcagttgttctccttggtttcggtgaggtccagacgagcaatgaccacttccacatcctctgccccttcatggggaatgcggtagaagatgcggatgtccttgtcactgggactacagttgaaggtgatgaagtgtctggcttcaccgaaagtacgaacacggttggtttgatagttgacaccatcacgagtgaagcctacgaagcagacgtgttcctgcatcttatggtagagagtgttcatactagtaccttcccgttgtgatcgaagcgagcaaggactacctcacagccttctgtctcagacatgtaggagagacggatgcctgtgtcagttggcttgcagttgttgcggttgtagtcacgcatctcttccaggttgtggatggtaggagatgtgatgagttctccgttggtgaccatacgtacgaaacacttgttgacacggaacacgctatgcggattggacatcagaggaactccagtcagaagggatcaaaggtgattgcttcaccttgaggatcagtgaggtagatgccagaccagagtccttcctgacctctgcacatggcagttgccttgatacgagcaacttcatcagagacagcttcgaactcatgttcgatggagtggagacactcgttggtgtaaagcagggtgtagatgttctggtccatggttgatacctatagaggactatgaagtaagtacagaatcgaataccactccatcaccgaaggtgtagaggaacatcagacactacccaagtgtagataggaacacggtgtgtatcgtgtagatggaaaagtgatgacaaggtatagggttgagaaaggtagagagaagggtgaaagagatgaacattgagatgaacagtgaatgtagagttgatgatagtgaatgcactgcaccatgccctatctcccctatcctcctacacacgagagatgagttactgtcaggtgaagagttaacaagagagagagagtatcccttccttcctacaacctactgtccctgagagagaggtgtgtgatcttgatgtgtgttcttgatcttatgtgtgctttgaaaaggtaacctctactccgtacctggataggtaaagagtagaggtagagggttaagccttggccttggtacgttccttgcggacggattcgacagcttcggtgagacctttctcctgaagttcctgagcgttctcgatgttgagcaaagcgatggcttgttcgcgttgcagacgagccttgttgttgaagtgagcggactcttcttcagcccactcggttacgttctccgcagccttggtcaggttggtgacagcacggaacatggactccagcatagcgaagaattggttgagagctttgaacatggtagtactccagagtagtgagaatggttgtggtgacacaggatcaatccacagcacagccgaaggcttctcttgatctagaagtacagacagatgattgggtagaagtagagttaaacaaggtggggtaggtagcgcgggaattccaaaactctagaggtaccgggggggataaccggatttggagagccgcagactgaagtactgcatccatacttctatgatgaatttcccacaaacccaaatcacctcccttactccctaagccaatccctttccacctagctcccataacccatagctgaggttaagtcgccaagcaccgagcgcagcgaggtgagcaggatgactggtccgaagctatgggttatggatacctgtggatatctatagtcaagttatccacaggatatacacaccctagtctttaccttggatgtagcagcctatctctctccacgcatccttccagtccctgtgcttgactggtgatacgtaggctaagccagtctctgtgtgagtggctacaccagtgaacaagccagtagctgcaaaccaatagagttccagtctgtggtttcttgctcgatcactcatgaccagtacaccaagaccgccgctcattacagtaggtgtcttcacccaatcccttgcatcacgtaagacaggatcgaagtctgcatccatgaaggtactctccattctgagtgtcgtacctcggatggtacctacccagtagaacaagccatccttcttaacgatatcagcctgcttacgagaaccacgactggcaaccctgcacaggaaactctccctgttctcttcagtagaggtagccttaagcttgtcctccagttcttttaccttggcttccagttcagctatcttcttctctgctgggttgttaggtactacatcaaacagttcagcgtactcagccagcttgacgtaaaccaagccagtgttgtcatctcctgcattgttgatgtactcatgccaggagataccaaggtcgatctctaccagttcttgccctggtagtttgatgttcagtactgctttgttgttcattgagtctaagcctcgcgcgcgttgaggtgggggagtagggaagcctcgcgcctgcggcccgagtcaaccccgagcggagcgaggggttgacgagggtaattcctcgtggtacccttggtattactcacccacgggggattacctatatattatatagggagtagaaggaggctttagggcctcctttttttgtgcctggaatactaccgttggtcgggaagatgaccgatggttacacccggtgggtaccggaaggtaggggtagcctgcttcttcagacgggatacctccagttccagttcatggatcttgtgtttgaggatgtccgattccgaggaaggcatctggggacggatgctcaccgaagccagtacccattcgttcatgtacttggtcttctgcgcgtcggtcatggtgtcccattcatccctggtgagaagggcatcaaggtagtaagccttgccttggatggtgaggacaatgcgaatcttgcccgtgtcgtttagttccataaaagctccagtagcatcatggctccgtacaggttcatcggtaccatgggtgcgaagataaagaaggcgaagacaggcttctccttccattcgggtgagtacctggtcacgtctatcgccgtccacagcaggagggcgaagaggaagtgcaacaggtggaatagccagaggtgttcctcacttgctggcttgggtacgtacaaggaccagaccagagcgaagatcaggttggacacccagtctgctttcattggtttggccccgcagtgaagagtactcgtgagtgagtgacgttcagaacagagatgccagtccctctgcgtaccagattgaggatctgagctacagtggagtagaagtcatcctgcacttcactgagagagtaggggatctctaccttgtgagaggtagtcttcccgttcttcagcttcatctgtacatgtgcatagctgatgtccattacagcttaccttcctggagttggtggatgccgtagctgtagagaagctcagctactttctccgactgctcgtatcccttgttacggagcatcactgtcatctcttctacctgcaccagcttgagtacacgatcaaccgggcactctgcatagcagagatggttggggtctaccagggcatggaagaggtcgccgtcttcattgatactgtggactgcgatcagagggatgttccccttctcggtgtactggatgcacagacccatgacgatcacttggcttcctgcaccgagggccagttttcttccagtgtccgggttgtgagtgagggtgtccctcaaaaggaataccttggtgccacactccactcgtgcgttacgggacatgagttccccgttcacgatgtggcgggcatagggttctagttgcatggtttactccttggtttgtacgttgtgttatcctcggcacaacctatagacaaccgaggtactaagatgactaccacccccgccactactgctcagcctgggatgttgacggtagatgagttccgctctgtgctacctgacaagatgaagaagtccatctccccggaagtactgaagacactcaatgacatgctgtccgatcctgacatggcggaagccttcagggacaacatcattgggtacacccatgtgatgaaggaaggtaagttcaagctggacaactacctccatgcttcgaagtacgtgacctataagctgatggggttgaacaacaccgaggcttacacccgtaccttccccaccaagatccagcggtggacccaacagggtgtggccaacaaggacatggccagctacatcaccagctacaacaagtcgaagctggtgaacctcatcctggaacaggcactgatcccatgccatgtgctcaatgctgacatcaagcagaaggcgatcaaccatctgttccacctgatgcagaacgctcagtcggagaaggttcagcaggagtcggccaacagtctgctcactcacctgaagtcgccggagaagacggagctgaagatagatgtcagtgatcgtgcagcagatgccatcgacatcatgcggcaaaacgctgaagcactggcacgtctccagcaggagatgatcgcgggcaagcagctgtcggcgaaggatgtagctgaacgcagcatggacttcggtgaagtcatcgaaggggagcttgcctaatgaacttggacgccacaccaatagcgaaagctgttgcagatgaggtggacttcgctggcttggatgaagccgccaagtctgtagagcaatggcttcgtgaagtagtctatggggatgactcttcgtacatccccagcatctttgccttgcagttcgttgacttcatcaagatggtcaacggtaacgaaggggaagagaacaagacaccagtgcttcacctacggatgcttgaccagattggctctggccagactcggatcgccaacatggtgttccgtggtgcagccaagactaccgtgatgggtgagtacctgttcctgtacattgcactgtacggtgagcttcctggtttcggtaaggtagaccttgctctgtacgtgtcggactccatcgacaacggtgtgaagaacatgcgtaagaacctggagttccgctgggagaactccgagttcctgaagaagtacatccctcaaaccaacttcactgacatccgctggaagttcacgaacctggacgggaaggtcttcatcgtcaagggctacggtgccaagactggtgtccgtggtgcgaaggagatgggtaaacgtccccagcttgcggtactggatgacttggtttcggacgaagatgctcgctcgccaaccgtcatcgcagccatcgaagacacggtgtacaaggcagtggactacgcactgcacccgaagaagaacatgatcatctggtcgggtacaccgttcaacgcgaaggatccactgtacaaagcagtggagtctggtgcctggaaggtcaacgtctaccctgtgtgcgagagattcccgtgctcacgggaagagttcaggggtgcatgggctgaccgattcacctacgacttcgtgttgcagaagtacaccctggccaagaaggcagggaagatcgatacattcaaccaagagcttatgctccagatcatgtccgacgaagaccgtctcatccaggatggtgaggtggcttggtacatgcggcgcaacgtactggacaacaagaagcggtacaacttctacatcaccactgacttcgctacctctgcgaagaaggcgagtgacttcagtgtgatcagtgtctgggcttactcccacaacgaagactggctgtgggtggatggaatctgtgaacgccaagacatgggagcgaacctggatgatctcttccggttgtgtgccaagtggcgtccacttggagtaggcatcgaagtctccggacagcagggcgggtacatcccactgatacagcgggagatggtgaacaaggatgtctactttcacatggtttcggagaagggtagtagcactcctggcttgcgccctacgaccaacaagctggagcggttcatggccatggttcctcatttcaagcgagggaagatgttcttcccttacgacatgaagagcacacggtgcatggtagagttcgaagacgagattcgtttggcttcagccggtggcttcagatccaagcacgacgacttcctcgacaccatctctatgctggctttgatgaatccaatccctccaagccaagagatccgcatggagtacaatgacagcgagatgatctgggaagaagcgtctcaacgagagaacacctaccaagcaggggagagctacatcgtatgacaatccaactcaagcaggtcattgacctgctagcagagggggaactcagcaacatcaagtacgtgaacatcgacactggtgctctcgtactggagcgagttccttcgctgattcgtgcaatcaaccttggagtactggacctgcacaagaggttcctgctcaaggaaggtatgctgaagatccaactggaagaaggtcggaggttgtatcctctacgtcctgcataccaagtgggacagaagccaaagcctggagtaccccagttcatcactgatgggaacaagctgggcagacagtccatcctgaagatcgagaagatcatcggggacaatggagtggagtactacctcaacgatacctggcagccgctcaacatcactactcctgagttcgatgtactggagatcagtgaagagttctactgtcattcgtcgagcaagactctggaagtacggtaccgtcgtgcacctacaccgatgaagatctgtgtggacaacctggacagttggggttgcatcgatattgatttgccttatactcacctccaagctctgctgtactttgttgcttcacgttgccagactccgattggcttcatggagaacactgcacaagatgggttcaacttctcgcagaagtacgaagcagagtgtgcgaatctggacgcacagaacttgcgtatcgatccggtaggaaaccaggaccgattcacaaggggaggttgggtgtaagggtgaggggaccaggacggtcccctctttttttatgcctggatttccttgaagcggacagcgccgacttcagcggaccagccttcgatggaaccttcttcgttgacgaagatccattcgccggccttcacgtccagggtggcaccctcgttgaagttgctgagggagtagacacgttcgccatcagcgttgtcgccgaaggctgccgtgatgaaggggaacgagccgagcatctcttgcagtgcctggacgttctgctcgtggtcttcacttacctgccagcccttgaacttgaggggctgggcgtgttcgtactctttgatcagttgcatgggttattccccagtagagccgaagccgccgtcaccacgattggtttcggacagttcttcgacgagttgaagttcgggagtagctaccggaaccagaagcatctgaagcacacggttaccggcttcccagtggaatggttcgcggtcggtggagactacagctacccactccccacgatagtcggagtcgatcactccgcaggtgttacgcaggcgaagacctgctttacttcccgtacccgagcgaggcagcagcagggctacatgcccttccggtacagcagcagagaaacccagctttaccttggttggttggtttggataagccaccccaccctccggcatgaagatgtcataccctcctgcggtatcactggcacgcacgggcatggtaaagttcgggctcagttgtttaatttccaagattcttacctcattggtttgaaagagagtaactatggcagacgtggacgaagattacctgacccttcccaacgaggatggggatcccagtaagcgactccagcctgagtggagcaatgctccctcactggctcagctgaagcaagactaccaggaggcgaagcaggtcaccgacgagaagatcactcagatcaatcgttggctcgactacatgcacgtccgtggtgaaggaaagcctaagacagagaagggtaagtccgctgtgcaacctccgactattcggaagcaagcagagtggcgatactcgtctctgtctgaacctttcctatccagccccaacatcttcgaagtgaacccggtcacctgggaagatgctgagtctgcaaggcagaacggtctggtactgaaccagcagttcaataccaagctgaacaagcagcggttcatcgacgagtacgttcgtgctggtgtggacgaaggtactatcatcgtgaaggtaggttggaactaccagtcccgaacggtgaaagagcaggtagtcacctacgagatgatgccggacagttccgaggaactggctcagatctaccagaccgcagcacagatccgggaagagagtccttcggagtacccggagatccccgaggatgttcgtcttggtttggaagagacggaagccaacggtatccaggtacgggcagtgcctgttggttcggaagaagaagagcgggaagagacggtggaaaaccatcccactgcccaggtgtgtgactacaacaacatagtcatcgacccttcctgtggtagcgacttcagcaaggcgaagttcctcatcgaaaccttcgagagttcctacgctgaactgaaggctgatggccggtacaagaacctggacaagatccaggtggaaggtcagaaccttctatccgaaccggactacaccggaccttccgaaggtgtacgcaacttcgacttccaggacaagagccgtaagcgtctcgtggttcacgagtactggggctactacgacatccatggtgacggagtactgcatcccatcgtagctacatgggttggtgctgtgatgattcggatggaagagaaccccttccccgataagaagatcccatacgtggtggtcagctacatcccacggaagcgtgacctctacggtgagagcgatggtgctctgctcatcgacaaccagcggatcatcggtgctgtcacccgagggatgatcgacactatggctcgttcggccaatggccaagtcggtgtgatgaaaggtgcacttgacgtaaccaaccgtcgccgcttcgaccggggtgagaactacgagttcaacccaggtgcagatccacgggctgctgtgcacatgcacaccttcccagagatcccgcagtccgctcagtacatgatcaacctgcaacaagcagaagctgaatccatgactggcgtgaaggctttcaacgctggcatctctggtgctgcactcggtgacaccgctactgctgtacgtggtgcattggatgctgcatcgaagcgtgagcttggaatccttcgccgtctctcggctggcatcatcgagatcgggcggaagatcatcgccatgaacgctgagttcctggacgatgtggaagtggtacggatcaccaatgagcacttcgtggatatccgcagggatgaccttgctggtaacttcgacctcaagctggacatctccactgctgaagaggacaacgccaaggtcaatgacctgaccttcatgctgcaaaccatgggaccgaacatggacccgatgctggctcagcagataatgggtcagatcatggaactgaagaagatgccggacttcgccaagcgtatccgtgagttccagcctcagcctgatcccattgcacagcagaaggcacagcttgaactcatgctgctccaggcacagatcgaagctgaacgtgcacgcgctgctaactacatgtctggtgctggcttgcaggattcgaaggttggtactgaacaagccaaggctcgtgctcttgctagccaggctgacatgaccgatctgaacttcctggaacaggagtccggtgtacagcaggcacgcaagcgtgaactgcaacaggcacagtctgaagcacagggtaagttggccatgctgaacagccaactgaagcgactcgatgaagctacttcagcaaggacttcccaaaagtagttaacttcactatagttggttcacctttacggtgaaccaacacccctttacttgacaggatttgcaaagatgaacgaagaacacgctattcagatcacccggaagaacgctgagaagttcgtccggctgcgtgacgcaatgctgcgtttgcacaagaaccgggacttccaggcgctgatcctcaatgacttcctcaaggacaacgctgcacgtctggtcctgctcaaggcggacaagaacatggaatccccggagatgcaggcacgcatcatccgcgagatcgatgcggtaggtgctctgcacacctacttccaactgatcggcgtacgtggtgacgaagctgaacaggccatcaaggactgtgacgctgaactcgaacgtgtacgcgaagaggaggatgaagagtaatggctgacttcctcgaaatgagtgacgacgatctgcccgagttctacgaagtagaagagcagactcgctccgatcaagaagaacccgaacaggaacaacagaacgacgagcagtcggaagaagttgttcaggaagaagaacctgctgacgaagagcaggaagaagaacaggaggaggaacaagatcctctcaactcgccggacgatgaactcggcgatcttcctgtagaagagaaaccgacggaagaagagtcggagcaggaagaagaagaagaagacggcgacaaggaagagtcggaagaaactccgactgaagaaaaacctgaagccaagaagtccgaggctaccaagcaagaggtagatcctgctgacttcatggcgaagatcactgcaccattcaaagcgaatggccgtgatctccaggtcaagacgccggaagaggctatccgtctgatgcagatgggtgctaactacaaccacaagatgtccgcgctcaagccgaacctgcacatgatgcgtcagttggatgatgctggtttgctgaacccggatactatcgccaatgtggtcgatcttctcaaacacaagaaacctgaagccatcgctaagttggctaaagatgccggtgtagatccgctagacttggatgagaagagtgttgcggattacaaaccgactgctgtaccattcaaccaagttcgtgaggcactggacgaacaactcgattccatcgagcatagtccatcctacaaccgagtggttactacgctgggtaagttggataaaacttctcagaagttggtttccgaacatcctcaagtcatcggctacttcgaacagcacatgaccaatggggtattcgaccgaatcgactccgagatccagcgccgtaaggcattcggcacgatcactgatagtaccccgtacctgcacgcatataaggcggttggggatgagcttcaggctcaaggtgcattcgacgatttggctcaagcctcggccactgaaagccaacgtaaagcacccgctgaaccggtgaagcgagtcaccacccgcaccaaggcacaggaagcggctgtgaaagaaaaacgtcgggctgctgctccgaccaaaactgtagctggaaaggctaagcctgcccagttcgatcccctagcgatgtcggacgaagagttcgagaagctgggcttcaactaagcaatccctgaaactggaataaggaaaacatctcatggccggtcctgtagataacatcaagccgatgaagtacaacgaccccgcgaacggggtagagtcttccatcggtccccagatccatacccgctactggtacaagcgcgcgctcatcgacgccgccaaggaagcgtacttcggtcagctggccgataccttctcgatgccgaagcactacggcaaagagatcgtgcgactgcactacatcccgctgctcgacgaccgcaacgtgaacgaccagggcatcgacgcttccggcgctaccatcgccaacggcaacctctacggttcgagccgtgacgtgggcaacatcactgcgaaaatgccgaccctcaccgaaatcggcggtcgtgtgaaccgtgttggtttcaagcgtgtcgagatcaagggcaagctggagaagtacggcttcttccgcgagtacacccaagagcaactcgacttcgacagcgatccggcgatggaaggtcacgtcaccaccgaaatggtgaagggcgcgaacgagatcaccgaagacctgctacagatcgacctgctcaactcggctggcaccgtccgttatccgggcgctgcaacctccgacgctgaagtcgatgcttccaccgaggtcacctatgactcgctgatgcgtctgcgtctggacctggacaacgcgcgtgctccgaccaagatcaagatgatcaccggtacccgcatgatcgacacccgtaccgtgggcaacgcccgtgctctgtacgttggttccgatctggttccgaccatcgaagccatgaaggacaaccacggcaatccggccttcatccccatcgagaagtacgctgccggtggtgccaccatgcatggtgaagtcggtcagctgggccgcttccgtgtcatcgtcaacccgcagatgatgcactgggccggcgtcggcaaggctgtcgatccgaacgaccaggttccgatgcatgagtccggcggtaagtacagcgtcttcccgatgctgtgcgtggcttccgaggcgttcaccactgtcggtttcgctaccgatggcaagaacgtcaagttcaagatcatcaccaagcgtcctggcgaagccactgccgaccgcagtgacccgtacggcgagatgggcttcatgtccatcaagtggtactacggcttcatggtgttccgccccgagtggatcgccctgctgaagaccgtggcacgcctgtaactaggcatgggggagggtaacctccccctcttaactcttaccctggagaatcacccatgtccctcgacgaactgcaaaacctgagtgaagcaccgctggaatccccggatacccgttccgagttggaagtcctgcaagaaaaagctactgcccttggcatctccttccgctccaataccggcgtggaaaagctgcgtgaaaagatcaatgccgtcctgaacgacgaagctgtcggcgacgaggaagaagacgaagccaccgaagctacctcgtccatcccgaagccgtccgccgaagctggtgcagctgccctcaaggccgccgaagcaccgcgtccgaagaccgagggtgaactgcgtcgtgatcgccggctggctgcgcatcgtctgatccgctgccgcatcacctgccacaacccgaacaagaacgactgggatgccgagtacttcagcatcggcaacgacgagatcggtacgatccgccgtctggttccgtacgaggtggactggcatgtgccggaagccctgctgaacttcatcaaatccaagcagtaccagcacttctacacggttaccgagcagaccccgatgggtccgcagaaggtacgccggtcgaagtcggtacgtgaattctccgtggagatcctgccgcagctgagcgaggatgaactcgaatccctccgcaagcagcaggcagtaaacggttcctacaaggaggactaagccatggccgtagagccaattaccattgccgacctcactgaggtcaagctagacggtaagggtgctctcgaccaactcctgcaagtcacccgcctgcatctggccaaagagcacgatgcagggcggttgaaggggcaggagtacgcagctgttctcactggtggcatcacggctgttcttcagaacgccgtgatgtttttgcttcagaaggatgaagccgccaacaaggctgcactggtcgaagcacagatcaagctcaccgagaagcaaggtgagttgctggacaagcagatcgcacaagctgacaaagacgctgagcttatcgctgccaaggtcaaactgaccctggaacaagcgaagctgccggattctcagattcgttctgctggcttccaggatcttctggttcaggaacagaccaaggtacagactgcacagactcgtcggatcgaccaagagatcctgtctgctggtttccaagacctgcttgtgaaagagcagactgcgaagaccaagcaagacgtactgactgctgtccaacagaccaaggtcatggaacagcaggtactggagtccactcagaaagtcctgaacatgaagcaggaactcttgaacctcgtggctcaggaatgcttgctgaaggctcagttcgatctgaccaaggaccaaggtctgaacacccaggagcagaccattctggtacgccagaaggtagcttccgaacgtgcccaaaccatcggtgctggtgtggatgccgactctgtgatcggtcgccagaaggagttgtacaaggctcaggctgatggcttcaagcgtgacgctgagcagaaggctgccaagatcctgatcgatacctggaacgtacgccgtaccactgataccggtactcaagccaacaccaccaaccggctggacgatgccaacgtcgggcgggtagtgaacatgctgatgactggtgtcggtgcctaaacagcgtgctgtacactaaggggaacttcggttcccctttttttattggaggacagcatgggtctgttcagtagcaagaagaagactgtggtgaacactacagtgcaacgagtgttcgatgatgcacacatcccggactctcctcgtactggtgtgatccaggggatcactcacgagactgggatcgtcgagaacatcctagagaagctgtccgactccattggagtacgggcgaatactgcctacctgtgggcacagcggaacaactactactggggcttgccagagtccaaggtagtgaatggtgtggatgctcgtactgtagtggttcaaaccatcgcacgaagcgaaggtacgatcaccacctactacaaccagttcggtccgctgaactccctgcactggggattcactgaattggtgcggctgtaccagtacaacccactgaccaatgaactgcctggactcagcaccacgaagggttcgaaggtctacctgttcgacatgatccctgtcttccagaccgacactgtggcatgggcagacgagacagcgaacaagggcatgcttcaggattttggtttcagtccgaagtctgggtacacgccaagccgtccgtacaacaccattgggggaatgggtcagttcgccgggtggtcaccctatcggacagacaactctttcggtgaggactacgttctactgacctacgaatggaaggatgcccagggggtcatcaagcaggaaaccattcgcatgatcatgaacctggacctgtccctggattaccatcaggttcggttccgtaggcagaatggaacccagggattcttcacctaccaggacggcaagggaacctatccgctaatcgatggagtgtttaacctcgactacaccaagcagggtacctactacccgtggatgtactgccgcttcaacaagatgaacgtgaaggacatcccaggcaatgcctacagggatgtgaaggaagtggccaagatctctggcattgggatcgacgagcttatcgatggggttcatgctgaccctgacatcggtgacgtggctcaggtagtactgttctacggtgtgccaccaggtgccacgaaccaggaccagctgacctatatcttcgagtacctgttgctgctccactcggaggcattggctcagatccagaaggcagagaacctccagggcaagctaggggattactccaacacggctgaccagatgatcaccatgcgggacaagtacttcaagatggacttctccttcagcggtatcacggtaaaccgtaagtccgggaaggttggtcctattggtttcatcaatgtgaagtctggtatggccgacaagtcctctggacagatcaagacccagcagccggcgtatacctacacccgtcaggccatggactccatgtacgacgaggtgatcatctacaacccggcaatgcactaccagatcaccagcaagaaagggcacgtagcccaactgggtcaacctgaactgctgatccctgtggaccgagtagtactcagtcagcttggcttgagggcacaggaacaactcctgtgccgtagcctgcacatggcgatcaacacccaggtacagatcaagaccccttggtatgccagtggcttcttcaaggtgatcctgattgtggtgtctgtggcagtcaccatcttcacagctggtagtgcctggggaaccatcgtcgcagcagcctccctcggagtggctgctctgaccatggtgatcgtacagatgatcgttactaccctggccgtcagctacggtgtgaagctgtttgtccgtgctgttgggcctgagttgggtatcctggctgcggtagctgccctggctgttggtgcctacgggatgtccaataacgctacctggagcgagaacctcatggcagtgagccatggtatcgccaaggaatcgcagaccatggaacaagctggtctgatggatactttgaaggaactggaacggaaccagacgtactacgctgaccaactccagagtctggaagaccaacgtcgtgaacttggtttggttcagttccaagcacttcagggtgaagacttcgtgaaccgtccgctgactatcctgggtgaaagtactgatgacttcttctccagaactgtacatgcggggaacattggggctgcaagcttccaactgacggaatacttcgtagatgctaagctacagcttccttccataaacgaaaccatagaggaaatcaacaatggcctatccgtacagtgatatgcctttcggagtcgagctggacacttccactctcggttcctttggcttgggtggtccccaaactcaactacagatgcagatgcctgctgtagacgtgaacgctgctgcctctggtagtggtggtttcatgtctggcttcagcaacatcttcagccgtgattccatgttcggtggtgtagctccgagcggtgctcaaaccggtggctgggtgatgcctgccctgggcattggccaagctgtcttcggtgccattggtgccaaccgacagcagcgtgctgcacgggatcagctggcagagtctcgccgtcagttcgacatgaactatggtgctcaacgccagtcgatcaataccaacctggaagaccggcagcgtgcccgagtggcatccaaccccacggcctatgagtctgtggattcctacatggaacggaaccggattcgctaatggcccaagagatcacttggcgtaacattggtgcaacggtaagtcctggcagtgcatcttcgatgtctgctgggactaccggtgtccaacaagcacttggtgcactgggtgacatcatctcccgtcaacaggagatgaatgtcaacaatgccaagttgcagcgtgaagccaacacgcaaagctatctggaccaggtggcagcatccaccctggaacaactcagcaacgcagactatcgcagtggactggaggcccaacgtgatgcgatggggatgaacctggatcgtgctgctactcgtgatgcgatcaccaagcagatcagtgctcagcagaaccaagcggctgctactcagaagttcgacgacatgcaggctgaggtaggtcaacgaggcatcgtagatcagcttcgtaccctggcagctgaaggccgtgctggtgaagtcaaccagatcttggctgagcaacagctgatcaacgagggcgagatccgcaaggaactcactggtgtgcaagatgctatccagaatcggcagtaccgggcagctggtgaacagcgtgcacaggcagcggccaaccgggcagctgaagcacactccctctccatggctgctggtcgggagaacctggctttcactcgtgagcagcgtgatgaactacgccgtgatcgggatgaagcgaagctggtttcgggaaccatcgctactaccttccaggactacgacgagtcccgccaggctcagagcgagatcatgcggatcgtgggcaaggaagtcggtatgcctaccgatgaccagggcatgcccgacatgagccgtgcttcgcaagaccagcttgatgccttcagcaatgcgctgaacgaagctggtgtacaagccaatacctctcctaccgagcggcggaatgctgcactcaagtctctcgtggatgcaggggtaagctcgaagggtatcgcccaggccaagcaagagatggaactccgggaatccctggagggtatggctccgcaagatcgcacgaaggttgaagcaaccatcggtgcggttaacgcagaactggataccctgcaacggacggctaccgaggactacgaacgggaagttgcacgtaacccgtttgtcgagcctgacaaggatccgctgggttcggtcaacaagatcgtagacaaggctgtgaagtctggtttcggctgggaaggtgaccgccaggatctgaacaacatgctcgtggacttcgccaccaatggcatcaagctgccggacggacgtactgctgtagtcccgtcgaagctactggagcaggcgttcaacaccacgaacacttggctgttcaagaatgccggtgacgtggagaaacggatcatcgaactcatgaccactgatggcatgactaagatgcgagaagacgctccgaccattcgggaaaacttcctgaaaaccgtgtcggacatcgccaaccaaaaacggtcaaatgccgttaaggtaactcgctcgtcagaacgggaaaagggtgttaccatggacccaaccgatgatctaacttttgcactacgagggaggaaacgatagatggctgatttcgacttggatcaattcctgtcggatcgtcaagaggcgaatgccggggctaccccggcattcgacgctctggactttgccagtgcgggcctggacatgaagggttcgcagaaggcttacgacctcgacggcatccgcgagcgcaagaagcgcaacgtggaagaatccctcatcggcaagatgggtatcacccccggtgctgctggcactgagatcctcaacactgctgcttccttcgtatccggtactggccgtgctctaggcgacgtgattgctctgccgatcaacgctgctgctgacatgggccaggctggtgtaaccaacgaagccatcgaagcctacaaccgctacgtctccgcccagatgcaggaaggtgatgaagccatcctgagccagactgctgccggtgacgacggtgttccccagaccatgctgcaacgtatgcaaggtgtggatgaactccgcaagttttctacaaacgtggacaagttcttcgactggtcgagcatcgtagacactactcgccgtgaccaactgagcgacgacatcgctgatgcgactgctggtggcgtagaacgtctccgcaatgcaggcgagtccttcagccgtggcgagattctggatggcttggtacaaggtgcactcggtgtcggccagaccgctgctaccgctatcggtgcatcggcaaccaacccgctggcagtcggcgagtacactgtggaaaacgctccgcagattctggcctatgccgctaaccctgtgctgggtgctgctaccaccgtgggctacgcctcggatgaataccgtgaaggcatcaccgagtatcaggccgagaaccaaggccaactgccggatgctgacgatcgtctgaagatgggtcttgctgctgcttcactggcggtagctgagcaggtagccaattctggcatcctgcgtggtatccgtggtgaaggtggtggtttgatccgctctactcttggttccagtgctcgtgaaggcgtgaccgagggttaccagacctggggtgagaacgttgctcacctgaaagacaccagtctggaagagatcgtcgaagccgcaaccattggtgctgctgtcggcggaaccatgaacatcggtggccgtgctgctgtaggtgcccgctctggtgctacccgtgctgaggctgctttggcttcgcgtgaagctgtgaatgctgcccgtgaatccggcgacatctctgccctgaccgatgtgacctcggagtcttataaccctgctggtgcagtggtagttctccaggaacaagtcatggctgatggtgtgacccaagaggtcaaggaccgtgccctggagcaggctgacaccatcgagcaggaagctgcccagcgtgtatcccagctggagcaggaacaagtcctgttcagtgaagaaggtctggccaaggtagagcaagccatcgaacaacgtgagcaggccaagcaaggtgctgatgaagctaccgttgcccgcctggatgaagaactggccaacctgagcggcgtgcgtgagcagatccgcaacatcactcctgagcagcgtcaggctcaagccaaggaactgaaggatgcccagcaagtactgaccgctactcgtgacgccatcaagcgtttccaggtggaagccgctccgaaggctgccgaggtagagactctggttcaggaagctgctgtccagccggaagcctccgagcgtctggtcaccctgaccatgatcaacccggatgccctaagcctggagcaggtagatgctctggtggctgacaccagcaacacccttaccgctgagcagcgtgcattcctgcgtagcttcagcgaagcacaggttgcactcaacgaactcaagggtctgagcggtgtacgcactgacatcgagtctggtggtgatggcttcaaaggtctgcctcagtaccgcaacgctgtgcgtatggctctgatgaacggcaacgaagaagcggctgctggtcaggtagaccaactgcgttccttcgctgacagtcgtgtggcgaagttcaatgccatcgacgctgcgtatcagcaggtcaagggtaccgacaactccatccgtatcgtacgtgatgaagctggcaactggaccgaagcaccggagtccatgactgcccgccaactgaagtcggctggtggtctggagatctccgctcgctccttcaagctgcgtgatgctgtagcactggaagccactgcactgtctcgctcggctgagtccctgggtgaactggtcaaggctggtccgattgctcgtccggcccctgtggtgcaagaagctgcccccgcacaggaagcgcccgtacaggtagctgaagaggtggccccggtagaggcgcctatcgctcaggtcactgaagatgtcccagtcagtgaaaccgagtcgatccaggcagaacctgctaccgaggccgaaactggtgaactcacggctatccgtgagggtgaagctgtgcgtggccaggaagttgctgctgagaactaccagactaccaatctggtttctgctttcttccagcaatccccggcacgtaacgacggtgacactcagaagcctctggtagcagtcaaagacttcgctaccaagatccgtactggtgaaggccgcatggctgaattcgctggtgtgaagagcttcactggtcagcaacagtctgccatcaagcagttcatgaagttccaacgtgctgccaagccgatcatcgagcgtacgctgaagccatacacctcgaagaccagtgacgccagccgttactacttccgggactatgctcagttcctggtgaatgctgacggtactctggacgagaacctgaccaccgccattgcctacggtgcgtacgactgggctatcgatgcttccaacaacctggtgaacaccgatgccggtatcaatgccatcctgggcaaggactccgatgatgaagtctctcctgctgcctatgcagtccttggcaacgtaggtactcgccaggccaccgcagcttcccagctgggtgccaagatcgttgatgtccttggtttggaagtcctgccgaatgctcctgttaacgagcgtgctcgtctggaagcttccctgggtgagcatgccttggctctgctggtgaagatgggtgtggcaaagatcaccactgtcagcgacgccaagctgaagtccctgatggactccaatgaaccggccaacccccgcgtcaagcactacttcctgaccccggtcagtgagcgtgtagacggtaagctggttccgggtgcagttgctcgccagatccgtgaagccaataccggaagccagtccatcctggccaagctgttcggttcgactgaaggccagactgaaccgagcttcactccggttcccttcacccagaagaacgccaagcgtactcagcagccggtacccaaggaactggccaagatcctggacgatgcaggcaagcgtcccatgcgtctccgtcaggacatgttccaagtctggggcaacctgtccgagaacgcattggccaccatcgctggtgctgtagatgttgaaggtggtttcgtacacaaggccaaccgtgctggcacccaagccaagaacgatggactggtacgccagatcgacaacttcaacgagttcttcggtcggatccaggaggtttctgaccttggcttggaacagccgctgtacttcgaccggagcgtgtggaagcctcagcgtgttggcttgactgccaacatgatcaacccgcagaccagcaaggtgcatcgccacatgctggcaatggaaggctgggagaacaccatcaacctgtccaacaaggcagagatggatagcttcaagctgcgtgtactggagtccttcggtgtgaagactgagggcaacaacacttcgaaagtgctggccaagtacgacagtaaggtgaacacgccggcaatccaggccggtgtatctgccctggctgagatcctccgtggcgaggcccaagacactgtggccaacgagtctgcaatcctggcagccgtagccgaagctggtgagaagttcttcagcttggatggcttggtagcactggctcaagagaagattgcccgtgagaacggtgctgagtccttcactacccagctgctcggcgaagtggacggtgtgaccaacggtcctatgctgtccctgctgatgtccggtgccaagggctttgacaccctgaaccagggtggtttcttcagcctggaagatccgtacacccagttcaacgactacaaggcacagggcaacctggacctgtacgagggcaccatcaaggctgtgctggaccgtctgggcaatgaaccgctgctgtcctctgtggaagtcatcactggtgtgctgaccaacgaggaaggcggtgtatcgtccaagggccgtaacgtcatcaagaagcccctgaccgcaatgatgtttggttccaacaccaagactgctgtcagcggcatggctgatgccttcatcgaaaccatctactccaagatggaagacgctgccaatgctggtgaccaagctgccctgtccaaggtgatcgctgccgtgaacagcctcatcggttcgaagaacagagacaagcgtcagctgtgggctaccgacatgggcttcgagcaagcactgaatactgtctactccccggtccagcagaccgccatcaaggctgccttctatgacctgctgggtagcaaggtagagagtgcactgaacgatacctacgaggtcttcatcgctcgccgtgacaccatcaacaagactgcgaacatggctttccagatgtacgaagctgtcttccaggctcgccgtgatgagctactggcttcggccaacctgcctcgtggcaatgatggccagccctttactgacctcactcgtgctcagatcgaccagatccgcaacgagttgaaggacatggaaccgatcctgcacaccgctttctcgaaagctagtggtgacctggattcggggatgctgatggcgaagactcgtcgtgaactgaacgactctcccctgtaccgctcggaagtccacttcgctgaacctctggagttcaccgatgaggaaggccgtaagcaatccgtgaagagcttccgtgccagtggcatgaccaccgtcaacgaaggtccgggtgtagctccgttcatcactgctacccacgcaggtgactcgttcatctcccacaatgcactgatgggagaagatgtcctgaacatccacgatgctcatggtgtaggtgtactgggcatggacgctgctggccaacgcctgaacgaacaaaccttcaagctgatgctgaactactcggcagccagtgagatggtttcgaccttcgagcgtactcttgctggcttcagcaagtgggtacaggatccgcaggttgcaaaccagttcggcaagtacctggaaagccagaagactaccgtctccactcagctggccagcatccgtcacgtcgctgaacaggctgacactgacaagctgaacatgctggccaacatgcgtgcagtaggtcagtacgccactgatggcggtagctacatcgtcaccgatgctgaccgtgctgctgctgtgaaggctcgtgaagagatcggtagtaccttcaatcctgaagcggagacgatggctgatgctatcgatgctcagctgaaggctactcctcgtgaagccaagcctgctgctcgcaagcctctgcgcaatgactcggtacagtccctggctccggctactacgctgaacaccatggaccgcatcaaggctgaaggtcagctgcaacaggacatccagcaggtagcccaggtgatggagaaatccaacctgagcttggagtctgcaaaggaagtcctgccggaagagcgtgctgctgaggtggtccaagccgttcaacagaacagccgtgacaagacctcggtatggggtgaactgggccagccgataactccgtctgaccaagcactggtggatctgctgaccgaaaccaatgacctgaccactcgtggtctggctgaggctctggtagcccgcgccaacgatcctttccgcaagcaggtgctgcgtgctgctcttcggtccatccgtgaagatgtaccggtcaagctgatcacctctaccactggccctgacggtgccatcggtgagggtgtgagcaaggctcgtggctggtatgcaacccgtggcaacttcgaggctctctacgtgaagagtcccgagttcgttgagtccggcatcactgaagagatgctgacccatgaactgctgcacgtgagcctgggtcgtaccatccagcgcgaactggacaagaaacaagccaatgccaactacgactctgctacttggcgtatggtcaatgacctggagatgatccgtgctcgcgccagtgacatgctgagcaagaacggtggtctgtctgccaagtacgccaacgctgtgtcgaacgtgcatgagcttgtcagctggggcatgacaaaccaaggcttccaggaagaagtcctgaagaagctggagatgcctgctggtaagcgtgatgctggtttcactgatggcttgctgcggttcattcgtaacctgactgccctgctgttccgtgacaccaagccgtccgataccaatgccatggctttggtgatcagcaatacctctggcttgttcgccgaggctgctgcacagatggccaagcgtagcgacctgaccctgaagtacgaggacgctgtagatcaggtcaatgccatgagcagtgagcagatcttcaatgccctggaaagcgagaagaccccgcttaccgaggctcacagcaacaagctgaagtctgtcctgaacagcatcgtcaccgagctttacggacccatgggtgcattccgcaacgaggttgctcgtggccaagcactgaccaccactgatgctgtcctgaaggctctggacactggccgcctgcccttcgcctctcaggcattggcttcggcgttcattgtcagcccgcaggaagcctacgtgctggagcaggttgaggctactgtggccaccactctgaacagcaacgatggaatcttcatccgcagcagcctggagaacctctggcgtgaagccaaggatcgcctgactgcgaaggacttcttcgctggtgagtgggaccaagccactcaagcagagaaggatgtggcacaggagaagtacaacttcctgttccgtcctgagcgtgtgggttcccgtagtgactacctgagccgctttgctgccctgggtgtagcgagccaggaagtagcgaacctgcttcagttcactacccgtagcagcgagaagtccttggctggtatgccactggctactcgtctggttgagatgttccgccgtctgcttacccgcctgggtcagctgcacgacaagactcgtccgggtgaggtggctgagagccgcctgttcactctggtggatcgtctggtggacatcgaagccaagcgtcgtggccgtctggctgaccagaaagtgggtgccctggaccaggtggaaactgccctggcgaacactggtgaagccatcaaagacaacctgaaccggatcgctgaatcgaccttcttcactcagtcgagcagtccctttgttcgggtagctggcaagaccatcagcaccatcaccaatgagcgtgttggcttggtcctggacggtatcactcgcatccgtgacaacgctttcaagagccagcacggcatggccatgcaggtagtgaacgagatgcgtggggcacacgagggtaacctcgctgcacacactctgttcaagcaagccaagtccaacgagatggctcgtaagcaacacatcgagtacaccgctgcgatgatcaacgaaggcttcaaggacaacggtcagtacctgagtactgaagaccgtgctgccctgaccaaaggtttcctacgtaccaacatgggtaacctgcgtgaagccctgggtatggatcggttgaaggaagtccttctggacaatggcgaattcgccaatctccgcaaagacctcgaagaccaactgctggcattgccgaatggtcagtatttcctgggtgctgtgaaggatctggcttaccaccgtgtgattggtggcaacgtcagtccgaacctgatgctgaacagtgcgaacatcgctgacatgctgggtaccaagcgtgtgctccagtcctccaaggcagaccgtgcgaaagccatcgaactgctggaccagctgcaagctgtctatgggtgggagtactctggttcgcaggtaaagtctcgtgctcgtgagatcctgaagaccgaatccaaccgtaccgagggtaatggtgtggacctgatcctggccatgcatcatggcttgggcaagcgttccaaggatgccctgttccaaggcaccgaacgcctgtacaccgatggctacgtaccggacatcttcgactccaagatcgaagtgctggctgtggaccgcagtgatctgccctacttccagaagcgtggttacgctgttgctggtgatgtgcaggtagaccaacgtgctggcctggaatccgacaaggttctggtgacccgccgtggtagtggtcaggttggtttgctgactggtgcaatgagctacaccggtgtgcatgctcgtggtaccaaagtggatcgtcaggctaccaacatgctgtcgtctggtcctggtactgcgaagaacactgttactgccatcaagcgcaacattgcacaggatgtgaatgacatgttcctgcgtgatcgttcctatgatccgcgtcagcagaagtctggtcgtgtgtctcctgtggtaaacccgaacggagccatcgtggactatcgctacaccatgactgaacacaaccgtgacagtctgctggaccgcgataactctatggaacaggtgctgggtacccttgcagggcagatcgtggacaaggttgactccgcaatccagaacgcagatgttgtgcgtgctatgtacgaccaattccgcgaggattacgccaaccgtcctagcagctacttggtagtaggcaaggacagcactgatccgcaactgcttgagttgtaccaactgctgccggagagcactaaacgtgagatccgtaagacttggggtagcgacaacatgcagatccctgctgatcagctgaacatgatcatgggttatcgcaagtacagtctgactactccgtttggtttggcagaagacgaacgcaacatcgctgagaaggtgcttgtacgagttgctgaagccatcctgggtgagaaggctgcacttcgcattggtcgtgctgaggatgtgatgcaggaactggtccgtgaagccaaggacatcctggtaatcaagaacatcaccactctcgtaggcaatattgtctcgaacatgactctgttggcttgggaaggtgttggcttggctgagggtgtgcgtgctcacgctaccggtatcaaggctgctctccagtatcgtcaggacaataagaagcttatccagcttcaacgtgccctggatgttggttacctgccttccggtgagcaagctgtacgcgatgagatcgctgtgctgatggatcgcctgaatcgcaacccgatcaagccgctggtagatgctggactgatgcccaccatcgtagaagatgtggaagctgatgactcgcagtacagctacaagtctttgctccagaagaagactgagaagtacaccagcaagctgccgaagttggttcgggacattggtcgtcaggtctacatgactcacgacactgctgtgtacaagttcctgagccaaaccactcagctgagtgatctggttgctcgttacgctctgtatgagcacctgactactcgtgcgaaggatccgctgagtaaagctgatgcactgcgtcaggctgaagaatcgttcatcaactacgacttgccttctggccgtggtcttcagttcatgaacgacatgggtctggtgatgttcaccaagtactatctgcgtgtgcagaaggtgatcgctcgcttgatccgtcagaagcctgctcgtgcgctggctctggttgctgtcaactactttgtgagtggcttgcagtcggtaatggatagctcttggatcaaccggattgggcacaacccgttccagtctggtccgtggtcctggccatccagcttgagtgaactaccaggtatcaaaggtctgatgaacctgtaatgaagaaagggggagctattgctccccctccttcttcctgctgaagcaatacttcaaccattcccatcctacccagcagaggatgagtagcacgatgaacagtgctactaccacgccgagtattctgaatatccagctgaatacgaagccaatgaacagaatgccaatcacggctcctgctagtgctccagcgccgaacaatcctttcaggactcccatacggactccttacttcttgtcgaggaaggccatacctttctgcacaacttcttgtgccagggcaggatcttgtaccgcagccgcataggacatgaggtactggatgtggatgttctcacccttctcgccgagtgctgcacgagtcatcacaccgttcggcagactggcagaccagtacagcgggatgctgtgctcgttggccagacgcagtgcttcatccaggagagccttcaggctcggagggatgtccgactcgtagttgctgccacgaaggctgtgctgtacgccctggcgcttggcttctactaccgcatctaccaagctcattcggccgccttcttgatctcgttgatgttctcgttacctaccgcacgtaaagcgcggaggaagcggtcggtttcctgcttcagggcagcgtcgaacatctccagggtagccataccgtcgtcggtggcattgtcccgtaaggtgttcgtcagcttgttgcgcatttcgatgaggtgtagcacacgtgtgacgtgcatgtttttcagcatgcacgctttgctcaaatcgcccatggcgaagttccttctggttgggtgtaagggatggagtgctctggtctggaccccattgcggggtggtgggtgtacccgttgcaacgggccagagcactcccttatgcctactggttcaatagacataagaaagccagctgggggtagctggcttggtctacagaggcatcagttaagggaggtggtaaacggccccttggatctagggggacaagggggacttggtagtggtatccaggggccgatgaggtggtaagaggttgtctccacttcatggttctcaacttacaggaggctgacatggcagtcaacactaaaaagagtccgcctacccgtaaccattacgagaacttcagaaaaggaatgaaggtagtgacgtatcagcggacaaaagggaatactctttttactgtggactgtgatcctgtggaggttgctgaccttcacgcatgctgaagccagagatccgaccattacggtagtctgctgcttcgaccgaaccagtagggtacgggttgtccttctcggagttctccaagccagcacgcacaccttcgaggtatgcaacggtggcatccattccaggacggaacggtgggttgaactcagcttcggtcatggttcccaggaaggagacactgagcatgatcgagttggcaccgataccgctacgctccttgatctgagcgatgagtggtacggtgaagtcgtggctcttgccctgctcgaaagcatggatggccgactggaatacggtgcctacgcctgtgggtgcagcgaaggccaggaggtagtacgacttggctttcatggtttactccggtagagacagccccctgttacgggggctatcggcctggaagaggtgttagctgaagaggctaccaccggtgctggccggggctgcttgttcggctaccggctcttcttccttggcttccatctcggtagccggttccggctcttcggtggctacttcgaccggcgctgcttcgcttgccttggattcggcaacggcagttgccaggccggcggccgcttcggtgttgacgactttcttctcggccttcttcggcttctcgacgacttccacggtctgcggttcggtagcgaccggtgccttggtgccgaccaggctggctacggccagttccggtacttcgacgaaagccacgatgccgccgtcgcccttgcgagtggtttggaaggagatcgacagctgggaggcgtcggctttcaggccgttggcggtcaggtaggtagcgatgccagcggcgacttcggcttgttgcagttcgattttcatcttggttccttttaagtgagcatggccagggccagcttgaaatcattgtgatggaagaccccatactcagctgctgcacaggcatcagccatgtgttcagcccggctggcgatcacttcccctttcgaggtacgcggccagttgagatgggggtatttcttgactgcccattcgatcatggcctccttcgaagctgtcttcgagttacaagccatgaccttcaggtcagtgggggtgagcaggtggaatggcttgccgcttgctctcacggcagagaggatcccaatacacatgccgtagcttttcatggctgcggcagactgggatcctacgggcacttccacgaagattacgttggcttccttgatcacctccatgactctggtggtgatctcggtagacctgttcaagtcatcgctgttgacgcgaatctgcttgtccttggtcttggaagtctggatgacttcgatatgccgtaggctgagggtgttggaggttgtgtcgtactgaccgcaggctagtccccagttgctcatactggggtccatgccgattacgttcagtcttgccattgctgcaaccgctcttcgaggatctcgatgaggttgttctgcacatccttctgctgaacgagcagactgcccatgtaagcatggaccgaggcagcggcatcggaacgaaggaacgagtacaggctttcctggcgagctttcaactcgtccagttccagcttgagtcgctctttcggacccatgttctgcttgtgcagcttctgcatgagttcgtagccggcgaacttccacacctcgtcttcagcgttacgacgagcgacttctttgccgatctcagcatcgaattcgatggggtccacacaggatgactgcccggtgaccgtccagccgttgaccagggtaagctggcatacggtggtcagtccgctgggaagtatcgtgaaagactcttccacgatcatgttcttcacgtcttgcgggttgactttcattcgctacctccgagtagctccagctgtttcttcagccggttgatttcttcccgtagcttcttggtttcctggtaggcaaaccaagatgtccccttgctgtagctcgccatgatggtcttcacttcttcaggggtcagtacggtcagcttgatgtcggaattgggttcacagaacatcgaaccgtcatcccaatcgaagccaggaaccacactcagcacatccacagatggcctcgccccgacagtaccggggcgcaggacagggatgcgtaaggtgtggtccagcaaccgttcgcgttgttgcgggttcgtgcagtagctcaactgccgcttcaacgaatcgagcagttcccggaccttcatggcttagctgaacaggcttgcgggcttgccgccacctgcttggccgcctgccggtgcaggacgaccggaagctgcgccgccaccggcgaccttcttggtcttgtcgcggacggtaccggccttggcttctttccacttgtcgaagaactcgggttcagccttggcacgggcttcgttcagggtcttcttggtgccgaagtggaagaccgccgccacgtcgttcagttcgcgggtttccgacgaatcttcgtactggccggtggcttcgttcttgacgcgcttgttctcgatgatcttctccagggccaggtagatgtccttgccggtcaggtcagcgaggaccggaacctgcttgggtacttcggccttggcgtcgtagtcgtagatcttcagggtgcgctgttccggcacacaggccgccagttctttttcggcggtcatgaggcagatggcgttgacgatattgaagcccggcagatagtgcttctcgccctcggcgttcacgtagtagttgttctggcctttttccttgctgctcgtcacgtactgctgaatcttcagcttgcgaccggtgccgtgctcttcgaactcgaagttcactgccagagcgccgccggaggattcggagccgtaggcggccaggatcttgaaggcatagatgtcggtgtcgaagatacgactgccgccgccgatgctgtccttggcttccttgatgtcgctgttgttgctggtgctgaggttaccgaacatagtgctgtttcctttcgatgcgtgaatcagttgtagtaccagtccagatggtcaagaaccttctggatgtcgttgtcgatgaaggtttgctcgtgcgtccacatacccatgggaccacgaatgcgctcaccgacagtttccttggtgatctgcgtctggaagacgtgcttgtagccaagcatttcctcctgcggcgtgatctccaagagcttgttgttctccttgaacggctccagcttcccgagttctaccttcttggtggagatcaccgtggagaagtaggactcaatgccgttgttcttcaaggcgcccttgaccggaacgcacacgtccatggccatggttgccttgttgtactcttccttggtgtgagccaggaagatcaccttgcagggactgctggcaaccttctgttgcatcagatccttgaagaactgctggaaatccatccacgcagcttgcccgttggcagcccggtagatgtactgggactcgtacatgtccagcaggtaggtgagggtgtcgatgatgatggtgtgggcttctacctttccctccaccactgcatcgaagacagtggggatctggtagggatcggtcaccgtccgctcgatgaagcgagacttgaacggcagccgcttaccggcttcgcagttcaggtagatgaccttctccggctcccggagattccgcagacaagcagacttgccagtagcggacagaccggaaaccaagaccagatggtcgttcacttgcgtcatgattgactccatgttggaagcgaaagggtgccgaaggcacccctaagctcagttgccgttggccccagctttcttggctacagagaccatgatggtggaagcgatctcgatctccgacagcttgtcagccatcttcgagttgagttcgttcaccttgccgtggattgcattgacgctgaagccagcatccagaaggatcattgcgtaacggagcaacatgttgttcctgttgccgtcgccggtgttgttgattacccaacgctccagcttgtccatcgacgcctgatccttgaggttacgccgacgctcttcatccttcgtggtcttcgggatgtagggcagtgcgtcgaacaactcaccatccaggtattcgtagtggccggcatgagatagccacttccgtgcacgctgaccgacgccatcgtccacctcgaaaggcagggattcgatgacggcgttgtagaactccttgtactccttggcgtccatcttcagggtgtagttcaacggcagaatgatgcggaagcgatcaccgttgccgtccgtctgatggcgtttcgtggtgtacagaagagccttgtagcccttcaggaattccttggccgtggacagcttgcacccatggtcgatgtcgataaccagcaggttgaaaccaacccggcagttctcttcattgcggtgaccctttcgctcttccccaccattgaggtggtggttgatccagtggataccattggcttgggtcatcttccataggtcatcccaagtcgctagatcgttgaagtagccgtacgcgatgtcctgcgagtaggccacgatcatgctcttgtcatggatgtcggtggcttggagtgcttccccacggaggaacatgatgtcctgttcgtaggtcttcttgatgatgatgttgttcttgtagccccaggcagtagccatgaccagcatgtcgtctttctgctgacgggagccacggtagaacgggagatcttcatccagttcggccacggtggtttccgagttggtcgctgccaggtacttcgccagcttcacgtagggacggtccctggtcatgagcatgtcgaagcactcaccagattcctcggcaaccttgatggccgcgtagaggtgatccatggtgagtaccggcgagtcgtccacgaaagcataggcacctgccagcttgagagccttgaagtaccggtgcgtcacttctgctttcttggcttcctggtgctccggcaagcctgctgcgatcttctcgcacttcagcttgtactcgatggacagcagagcggtgtccttgtccatggtgagcactcgacgcatattgcttgcgtctgccagacgttccaggtcatcgcagagatcttcgatgaaggtggaggtggagttcttcgtcatgaggtcatagacctcttccggggtcatgtccaccttcttgccttcgccagccatgccgaagaagcaacgacgagcgtagccagtctccagcaactccatcagctggtcctcggtcttgccgccatccagcagcttgcctggggtaccgaaagccatgaggttggtgggcgtacggccgatgatctcttcgccgcgaaggttgtcgttggtgttcttgaccagcttctgcttgaccgaacccacgtcgaacagttccaggaacgtcggcatgatctcggtcatggcaggcaggttcaagccaatctcatcgacgacgaggttgaccgcaccagcgttggccatcagcagcttgtgacgcatctgcttgacggctgggccagtacccgagtcgaagtcatacagcagggggccgagagacttgaactccttacggacagcttcctgttcgtcgggtagttcggaccccttacggatgtggcgcttgaacgccagatcgtcaaggtgcttctcggctgcggtgtcgaaggtttccatgaaccgatggcggaagccataggtaatctggtcctccatcacctttgtggagaaacccttacctgcacccgaaggcatcaggttgagggcgtacatgttgaccggaatctcgccgcgttcgtgagtcttgatgtggcaacgcatgtgcgctgccatcatcgagaactggaagccaaccaagatcctgaagaacctgtggttcttggattgggtcttctcacacagaatttcgacgatgcgttccgaggtcgggtggtgttgcatttcctcgtacttgagcatcacttactccaggtttatacgatgaggtcgcccttggcgatgagcatgtccttctgcgtacacagtaggtatgccgggcagtagaggcaggctttcacttggccagggatggtcttcactacgccaacgttcccgtccttggcacggtgagccatggcttccgacaggctgtcgaagttcttggtgctgcgagcacccttctggtcagccttggcggggtcacgatagtacttgtacaccggctggctacgccatagctcttcgtcgctgcacaggggcagatccgcttcaggggtatccttcagggacatcagccacttcaccctgttggtgatccactcttccgtctcggcgatgggcatcaggttgaataccttcgaagccacacgactctgagggtagtccttgttctgcttcgccatgaacttctgccaatccgtgaagatgaagtggattcgcatggtgtccttggtgatcagcccaggattgagcgcacggtagatcgacccttgcaggatgtagtcgctgtccttcgagtccttgatgtagctgaaggtggtagtggacttgaagtcctccacctgaccgtctgccacgaagtcgtacttgccggataccattactcctgcgtactccttcttggaccgctgctccatgtagacggtgatagcaggctgctcgttggcttcgttgaacgccttgagttccgcctcggtgggattcaccagcacacgtttagcgacgcttgcagggatgcccagggcatccagtgcccggtccttgttcacggtccaagccttctcgatggagtcgtgaatcgccgcccccatgcggttggcgatcatgccctcgatatcggccatggagtcggatggcttgatacgacgagccaggactacctgcctgattggtttcagcagggtggtagccgacagccctgcttcgctgtagtcgtagtagtccgaagccagccacaaagccatggccatcgggatacccgtctggttggtgtagatctgacccatgtcagtcgtcctctcctgcgttgtcttcaagccaacgattgagggtatccctggcttccttcacgtcttgccagaggctcttgccgccgctgcgttggcctggtgccatcagcttcttgcgagcgtggtccagggcaccggatggatccagttcacccagggggaacagcatgttgatccggtacacgtctacgaacttccaggcacgtgggatcggacgctggtagcgattcaggggtgcagtatcacgctggaccttgtgggccggttctgctgacttgaccggcaacctgcggtgaagcttctcgcagtcttcacagggttgcccctgtggatgctgtgccttacacacggggtgaggcgagtatcgtggatctctcattggcttgctccaaagtatcggttgaggtggaacacggctagcttggctgctgccatgtagcgaagcgcttgtcgcttctccaaagccatgccacccatgagcaggtcgtagcacagctgaggttcttgtaacaggacgaacagacgtgcagccgacaacggcctctgggagccctctgtggctgatgcgatgcctgagaggatgtcctctacccctcggtctgaaaacgcatcaggcagcccctgtaggcgttttgcgtggggattggtaaaccaacgagtccgtggtcctcctatcgatctacgatccaagccatgaaacctgatggtgtcagcccgagccttgcccatctgagccaggagatttggcatggagtcgatggggaagtccttgaagggtacgtcctcaggggtgagtttttccatgaaaacctcctggttaaaaaatgatcacgaaagtgtcttatatataatagggactctcacccctcttctttcgaaggggttcgcccctggaaggggccgtcccagggcgaccactagcgctcaccctcccccttctccatccagggaaggggtcaggtgaagtggtcgcccgaggagcgagcgcagcgagtcccgcaagggatgacccgtaacctgacccctgaccgggggaaattgaatattcaattattccttccgcctatccacgcatccactcccgtctcgctctgcggtgctcgctgcgctcgatcctcggcggactgcgttcctgcgtggataggctgggggaggttagggaggttatactttgaccaactctggaggaaccaacatggtagacacttgcaacatcaatggggtctgcggaaccggggactggaatggtcctaagcccggtgaccccaacatgaatgatctgctgctgaaggcaactcctgccttcggtggtatcgacattgagttcacttggccaactacgaacccaggtgcagttggcactactcgactgttccgaagcactgacgctaacttcgctggtgcaactatccgggccttcgtcaacggtaacttctacttcgacaagacagaccctggctccaaggtagatcaacgctactactattggattcagttggtttcgatcaatggcactgatggggacatcattggtccagcttcggccactgctcgtccactcattgagcagatgattgagcagcttactggtgagattgacagtggtcttctttcccaagagttgaggaaagagattgctcagatcgaactgaacaagctggggatcacccaggaagagattgagcgagccaagaacgatgatgctcttggtgttcgtctcactcagatcgatgcaaagatggatcagaatactgccatcttgcaggaagaggttcgtgctcgtgtaactgctgacagttctctggttcagacggtcaacaccatgtacgccgacttcaacgggaacatcgcagcaatccagcaggagaacactgcactggcaaccaaggttaatgccttggcttcttcagtgaccacgatcaacgccacggtcaacggtgactcagcctctggtaaagttggcttggttgctgaggtacagaccctggacggtaaggttacccagatcggtgctcgatggactgcgactgttgatgtgaatggtttggttggtggcttcggtgtgtacaacgatggccgcactgttgaggctggcttcaacgtagaccgcttttggatcggtcgtcctggcactccgaagaacccaggcagctacccgttcatcatcgacaacaacatcgtttacatcaaggaagctgccatccagaagttgaccttcgacaagctcagggcacaggatggcagcttcattgttcagaacggtaagatccaggctgactacatcgaagccaaggatatcgtggtgaacaacatccagtcggacaactaccaaccaggtgtccaaggctgggcattccgtcccaacgggatcatggaaatcaacggtacggcaggcactggccgtatgactatcaacaacgccaccatcaaggtgtttgaccaagcaggcaaactccgggtgcacattgggaacctacaagcatgagttacggattccgcttttacgacgccaacggtaacgtcaccgttgactcaaccaacaagtccttcaggtctgtgtacaggcaacaggtgtttcctgtcctagggggcactactaatttgccccctggttttgatgcaagtaagggggacatcttcttctttacttggtttcaactagcacctaacccatggcctcagtttgtagactttggtttcgtcaataaccagatccagtggtacgacacttactctactagctatggcaaagcctatctcaacgtggtgagcttccgatgacttacggtattaaactgacaaacgaaaacagtgacatctgcatcgacgagttgaatcccgtctatgttgttgtgttcgaaggatcctataagtatgacagccctgggcaagactttatctacgtgcagttccctacccctatcagatcacagagcttgccaattttcttcgctaagcaagatggccctcatggtttcatggacttcacttggttcggttctaacggtaactggaccggttgtcgctttgtactgaccaactttgctggtatggctccttcggtgtattccggtaagtacaagatcgttgctgtgcatatgccaaagactgctggctggggtatgcaggtatttgacgctgatggtaatggcgtattcgatactggctacacaccagcagtattccttggtggtatccagaggttcttgccctacggctacaaccctaacttccctggtggtcgtacactggggagttggtatgccgatgcaaccaaaatcaagcagggtgcctacttccgagtggacttcggtaacacaaccttcaggcacaatggtttcaccattggaatgcttaacggccctacgggttggatgtacatcgctgctttcatcagcggcaacaagcccggttacactattgaccatcctttgttggccatcgaataaacggtacactgcacgctccattcgaagaggatacaaccatgactaccaaggtgatcttcaccttccataatccggatggcagcccacaggcgaacgagaagttcaccgtgcgactgacccgtcctggcatgagcgatgcagagcactgcgtcgtaattcccgaaacctacgagatggtgaccgacgccaagggcgagttcaccatggacttggaatcgtctacctctgcctaccgcgtcactgctataggcgatgacgacgagtacgaggacgatccctgctcgcagtacaccttcaccttctacgtgccggactctgttgatccggtctacgtacaagaactgatccttatgcctccgcccaacaacttgccatgggacgaggaagccatgaacaagatcacccaagcggtggtcgatgctcgcaatgcacgagacgatgctgaagagtctgctgaccgtgcagaggctcaggttggtttggctgctgagcaagtgacccttgcaaaggcagaggtgaccaaggctaccgcccaggctgaccgctccaagacggaagcggaccgggctactacccaagccaccaatgcagccaactcggctactgctgcggccaactctgccacccaagccaacacgcaagccaaccgtgctaagacggaagctgaccgctccaagagcgaggctgatcgggcacgggatctggctgatgccgtggctgaaaaggtcgagggcggctcgctgcctcctctggtgggcatgaacgaaaccttcacctacgaaggtaccgacccctaccgatggactgtatctggccctgctacggctgtctcggacggtagcgtcatgcgcctgaccaagaccgatggcagcggttcccgtgcgttcgtacggcaggcagtgtccttcccggacagccactggatcgtctacatgcgtgtgaagacccagaccggtaccgcctcgcggaactgttctgcacagatccgcttcatcgctgctgacaacaagaactgcgtggtctacttcaacgtcaatgcgaatggcttggtggaacccaacaccatccacatgcaaggcaccgagggtgatacccgcaacgctgcaaccatgttcactggtttgggaaccgaggactggctagaccttgctgtgaagtacgatgcggtaaaccgccacatcgaactcttccgccgcatgcccaatggcacttggcagaagggtggtggtcgtctgatggtagatgccatcaagcctgctttcatcgagatctcgtcgatgccggtagccccgcagaactggtggctggatactgacttcatctcggtgtgcaagcccaaccttatctgctacggcgacagcattgctgctggccagaacgagtatggggtaacccgtgggaacaacccctacaacaacaaccgcaactgggctggtacctggttcggaaaggttccgctctacgccaccaaccggaacaacctggtgcttgtccagggcgtggaaggccgtcgtacctggcagtacctgagccagctgtcggagatctccaactccggcgtgaaggtagtcttcattcatgccagcacgaatgacgtgaacgatgccaccatgaccatggccaagcgtacgtcggacacccaagccatcatcgaccagcttcatgctgtcggtgctcaggtagtgctgttcaactccatgcagggcacgaaggcgtacaacgatgcttcgtccactaccgtcaagctacgggactacaccgaccagtggtggaataccgaactgcccaaggtcaatggtttggctcagaccctggacatcgctcgactcatcgccaaggacgggtacatggaccctgccctcggtgcgagtgacggtctgcacctgaccaatgcctcggcacagaagatcgccgacaagcttggccagttcttctccaactccagcgataccaatggcttcgcttcgttggatagcccagccttcactggtatcccgactgtacccacgcagactcctttcctgccttacggcaagcagatcgccaacacggaatacgtaagcaccttcatccaggactggaccagtaattacgggtacggcgacctgacgatgcggaacctcaccggtgcccagatggcaggcggtggggtgcgtagcggttattactatgttcctggggattcttctaaccccttgccggggaatgtttatgcattcgtgcaccacatgtcctacgacaccaacaagggttgggaactctggaaccactgctacaccgaccgtgtgtacatgcgttattcgaacaacgcaggtgtatggaatacgccggtagaaatggttactgagaagtggatggagcgtaatagcttcatgaccccacgggtttctgcattcaaccgtctgcccgtggcttcttctgttggttttgaaggggttgttcccttgcagaccaacagtagtggggcttggcgtaacgtgaatgctggtgtagctgggttgggccttctcggtgcaactacggctggtaatgcactgaactacattggtggtatgcccaaagccccaaccaatgatcgggccaacagtaacctcaacaatttacctgatgagtgtggtttctacggtttgggaccagcaccgtattccaatatccctccgggggttgatgcgattaacccagtgggttctaccgtctaccatcaggtttacgacgccaacaccgctacgcaaattttcattccgcgtacttcggacatctgctatttccgccgtaaggcagggggaacctggagtccatgggttcgttacctgactgatttgcagctggtaggcaccactactgacagcagtgccggtgttccgaatggtgccatcatgcaggtcaatgggagtgctgctgtaaacgtaggtgttgccctccgctttgcagacggtactcaaattgttcgggcgttactccaattggattacggtgcagtagatatccttcagcgtcagttcactttccccatggcttttgtgggtaagccggtggtaaccgccaccctggaacaaggtactgttgctgacatcaacaacatgcctttgcaggctcttggccctgttatggttgccagtatctatgcaggcaactgcaacgtgcgtgtcatgcggtct

SEQ ID NO: 4 - DNA, 43462 bp, Unknown
  Description of Unknown: Undetermined Bacteriophage F197/08 polynucleotide
taaattatccaagagatgttagtactaacggtactgtcgaatatttagtagtaacttcagattacaagcgtatgacttatcgaccgaacggtacaaataaagtgtttgttaaaagaaaagaagcgggttcatggtctgagtggtcagaattagctattaatgattacaatacaccttttgaaactgttcaaagtgcccaatcaaaagctaatatggccgaaagtaacgctaaattatacgcagatgacaagtttaataaaaggtattcggttatttttgatggaacagcaaatggtgtgggctctacattgtacttaaatgagagtttagaccaatttattttattaatttttttatgggacttttccaggtggtgactttacagagtttggcagtccttttggaggaggaaagatttcattgaatccctcaaatcttccagatggtgatggaaatggtggaggtgtttatgagtttggattaactaaatctagtcgtacatctttaactatatcaaacgatgtctatttcgacttaggaagtcaaagaggctctggtgcgaacgcaaatagagggacaattaacaaaattataggagtgagaaaataatgcaaatattagttaacaagcgtaatgagataatttcatacgctatcattggcggctttgaagaaggtattgatattgaaaatttaccagaaaatttctctcaagtttttagacctaaagcctttaaatattcaaatggggaaatagtttttaacgaagattattcagaagaaaaagatgacttgcatcaacagattgacagtgaagaacaaaacacagtcgcttctgatgacatcttacgaaaaatggttgctagtatgcagaaacaagttgttcaaagtacaaagttatcgatgcaagttaataagcaaaatgcactaatggcaaaacaacttgtgacacttaataaaaaaattagaagaggttaaaggagagactgaaaatgcttaaattaatttcaccaacattcgaagatattaaaacatggtatcaattgaaagaatatagtaaagaagatatagcgtggtatgtagatatggaagttatagataaagaggaatatgcaattattacaggagaaaagtatccagaaaatctagagtcataggttataatcttatggcttttttaatttgaataaagtgggtggtgtaatgtttggatttaccaaacgacacgaacaagattggcgtttaacgcgattagaagaaaatgataagactatgtttgaaaaattcgacagaatagaagacagtctgagaacgcaagaaaaaaatttatgacaagttagatagaaatttcgaagaactaaggcgtgacaaagaagaagatgaaaaaaaataaagagaaaaaatgctaaaaaatattagagacatcaagatgtggattctaggattaatagggacgattctaagtacatttgttatagccttgttaaaaactatttttggcatttaaaggaggtgatcaccatgcttaagggaattttaggatatagcttttggtcgtgtttctggtttggtaagtgtaagtaatatttaagagtcagtgcttcggcactggctttttattttggataaaaggagcaaacaaatggatgcaaaagtaataacaagatacatcgtattgatcttagcattagtaaatcaattcttagcgaataaaggtataagtccgataccagtagatgaagaaagtgtttcatcgattatcttaacagttgttgctttatatactacatataaagataatccaacatctcaagaagggaaatgggcgaatcaaaaaattaaagaaatataaagctgaaagtaaatatagaaaagcaacagggcaagcgccaattaaagaagtaatgacacctacgaatatgaacgacacaaatgatttagggtaggtgatgaccaatgttgataacaaaaaaaccaagcagaaaaaatggtttgataattcattagggaagcagttcaatcctgatttgttttatggatttcagtgttacgattacgcaaatatgttttttatgatagcaacaggcgaaaggttacaaggtttatacgcttataatattccatttgataataaagcaaggattgaaaaatacgggcaaataattaaaaactatgatagctttttaccgcaaaagttggatattgtcgttttcccgtcaaagtatggtggcggagctggacatgttgaaattgttgagagcgcaaatttaaacactttcacatcatatgggcaaaattggaatggtaaaggttggacaaatggcgttgcgcaacctggttggggtcctgaaactgttacaagacatgttcattattacgatgacccaatgtattttattagattaaatttcccagataaagtaagtgttggagataaagctaaaagcgttattaagcaagcaactgccaaaaagcaagcagtaattaaacctaaaaaaaattatgcttgtagccggtcatggttataacgatcctggagcagtaggaaacggaacaaacgaacgcgattttatccgtaaatatataacgccaaatatcgctaagtatttaagacatgccggtcatgaagttgcattatatggtggctcaagtcaatcacaagacatgtatcaagatactgcatacggtgttaatgtaggcaataaaaaagattatggcttatattgggttaaatcacaggggtatgacattgttctagagattcatttagacgcagcgggagaaagtgcaagtggtggacatgttattatctcaagtcaatttaatgcagatactattgataaaagtatacaagatgttattaaaaataacttaggacaaataagaggtgtaacacctcgtaatgatttactaaacgttaatgtatcagcagaaataaatatgaattatcgtttatctgaattaggttttattactaataaaaaagatatggattggattaagaaaaactatgacttgtattctaaattaatagctggtgcgattcatggtaagcctataggtggtttggtagctggtaatgttaaaacatcagctaaaaaccaaaaaaaatccaccagtgccagcaggttatacacccgataaaaataatgtaccgtataaaaaagaaactggttattacacagtagctaatgttaaaggtaataatgtaagagacggttattcaactaattcaagaattacaggggtattacccaacaacacaacaattacgtatgacggtgcatattgtattaatggttatagatggattacttatattgctaatagtggacaacgtcgctatattgcgaccggagaggtagacaaggcaggtaatagaataagtagttttggtaagtttagcacgatttagtatttacttagaataaaaattttgctacattaattatagggaatcttacagttattaaataactatttggatggatgttaatattcctatacactttttaacattactctcaagatttaaatgtgcgtaactggcaggtacttcggtacttgcctattttttttatgttatagctagccttcgggctagttttttgttatgatgtgttacacatgcatcaactatttacatctatccttgttcacccaagcatgtcactgggtgttttttccttgcgatagagagcatagttttcatactactccccgtagtatatatgactttagcattcccgtataacagtttacggggtgctttttatgttatacttacttttatatagtaggagtgaactatatagccgggcagaggccatgtatctgactgttggtcccacaggagacatcttccttgtcatcactcgatacatatatcttaacaacatagaaatgttacattcgctacaaccgtatcttaatcgatacggttatatttattcccctacaaccaacaaaaccacagatcctattaatttaggattgtggttatttttttgcgtttttttcggggcgaaaaaaagggcagattatttgaaaaaagggcaaacgcttgtggaaaatctaaaaggttaaaaaatgacaaaaacattgatacaacagtgttttttggacgctcgtgtacgttagagaatgaccgctttaccatcacaatatgatgatatgtttatttcaagaaaagctttaacgccagtgttctcaagcgttttataaagcttgtaaaaaaatataagggcaaaaaaaagggcggatttaagctaacttggaatgttttcgagttttttgagttagttctctatccatttttttcagttacatgagtatatatgcgaatggttgtttttttcatctacatgtcctacccttttcataattgcttttaaagaaacattcatttctactaataaagttatgtgtgtatgtctaaatgtgtgcgtggtaactttcttattcatatttaaagcttttgtagttttcttaagcacaccggcgatttgattattacataaaggattcccttttttttgttgtgaatatgaaccctctgtcaacatagctcgaattccatcttttcaacattttgttttccagtattatctttttaaaaatttctacggttctagaattgatgctgatacttctttttgaacttatagtctttgtagtgtctttgtatccgaatccttcctcgtatttaatgcggtgaattgtacctgttatattgatagttttgtttaataaatctatatctttttcctgcagtgcttgtagttctcctatgcgcataccagttaaagcctgtacttctaagatgctggcaattaaaatgcgatttcgcttgtgtaacttattatcatttagtatatgatcacgtatctgtaggacttggttcatttctaaatagttgtacattttagattcatctttttcgatatcctctattgtttttcttcttttaggaattttgacattagttaacaaatattcatttggataattgtaaaatttaactgcatatttaatagctcctttcatatctccgagttgacgggttacttgattttgagaatagatatctgataatttattaataaatatctgcatatattttgtatctagtttgtttaaaagcaagttctcagagctgtatcgtttaatgtttctaattcttatttttatattattaagagtagtcaactttgaacctgatgtttttatatgatattcaagccattcatctaatagcgcgtgaaaagtcaaagtttttaattcgcttgacgacttgttgttcagttttttcttttattttttcttctaaacgaaacattgcttcttttttgagattgttttgtattcttgttcaacacaacacttacgcgcttccatttatctgtgtatggatctttatacttctcgtagtatctgtatttagtttcgttatttttgtttttaaatttttcaatccacatgtttatacctcctgcaagaacgtatgttctataaaatattaaaaaataataagggtagtcgggctacccgtaatttagtactaggtactaaatgtgttataataaaataaaaagtaggtgataagatgactcaatttctaggggcgcttcttcttacaggagttttaggttacataccatataaatatctaacaatgataggtttagttagtgaaaaaaaacaaggttatcaatactcctgtattattgatttttttctattgaaacatgtttgatatggttttataatttttaataatgttgatttaaaaaaatttgaatttaattcagttgcttacaggtctaaaagcaaatattttgtttctatttatttttgttttaacagtgtttgtatttaatcctttaattgttaaatttattatctggttaattaatataaccagaaagtttatgaaattggattgtataagcttattagacaaaagagacaagttgtttaataacaacggtaaaccagtatttatagttataaaagactttgaaaacagaatcattgaagagggtgaacttaaaacctataattcagctggtagcgatttcgatttactagaagttgagcgacaagatttcaaagtatctgatttagcgtcaaacgatgaattgtatattaaacatacgcttgtagaccttaaacaacaaattaaattggatttatatttaatgaatgaatactaatctttttttcttagctttttctgataaagtgctttttaatttttcgctggcgcctgacttttcaaaacttttgtttaatgggttactacgagtagtttcttgttttttgtttttatctaccataaaattctcaccaccattcaacgtctacactagtaggcgtttttttgatttttttttaatcctttttctcgtcacgctatataggtacttttaatcgtaattaaagccaagtttatttaaaatctctaaataatctgacgactttgcccgtaatgtttacgtcatttatttttgacattgggtagcttctatctttaatggtaacgtaattagataatcgctttagggtaaatgtgtcatctgagttaaatataatttcacaaaaatattcatcagtcgcagttccgttttcaggacagtaaacagtaattatatctctgtcaaagataaagtccattacatcatcatcctgatctaaaatgtagcaaacagtcatatcttcattttcaactcttcttgcgctatttatagtagttattggttgtgcaactaatttgccttttgcctctgtgtatctttttggaaattccacataattcattaaatcgattgttttatttgtttccatattagctcttctttcttatattgttttattagttaatattggctcctggtactgcgctagcaccagctcttgcttcctcttcttttccttttttgtactcttcaaaagctttagcctgttcatctttagtccagccaggcgaaacgacatactcatcatttaaattagtattttgtgaatcgttttcatttatatttgcaggagtattattagatggatctgaattattattaagttgattgttttgtgattggttttgattgtttgaattattttgtatgctattattaggtggattttttatcttcaactttttttcatttttttcttgttgcgtttttggtttgctatctttgtgtttttgtgtttgtgacttttttattttcttcttttttttggttttttcttttttcaccacaagctgttaaagctaatgtacttactagtagcagtccgattactttttttcatatgtatctctcctttgtttatatttccttatatttaaaaactctcaacggctcaaacgtaatagaatactcgccatagtgagttccaataccatatatctttttatattgttctatagcttctagtatgtatgattcactcaactgcagatactctgacaactcgtacaaattacgaacaccgtagttgtgagcttctacaatttcatgtagcggtacagctgaagtaaaaccatgtctacgtgcataattttcaaattttctattaatccattttgtttggtctaaaatgttgccatacgtcaacttgtggtgggcaagttcctcatataacacttctgctttacgtacttctgataaattacgccttatataaatttttccgttcatatagcatccaggttggaaatttggaagctggtcagtttcttctatctttattttttcgttatttatgcaaagttcttcgtataatcccaatataaacaccctttatttgtctctatttctaacccattcaatgaatctatttacttcttcaatctcttcttcagttaatccctccttatcaaaatgagcagcaattgtttcttgatgtatatctttttttgattcagtaattcttgatttcggtacattgaagtaatctgcaagttgttgaattcttttaattcgtggatatttagtttgttgaatccaattggagactgtaggttgagaaactccaatagcttcagcaagttctctctgatcaatatttttatcattcataagttcttgaaggttttcagataaaatttttctgactttattattctccatagttgtctcctttaatattacttaatgtaatattaacttaccataaccgacattactttacaatactttttataactttttatgaagaaatataactttatctgttgacaagtaatacaaagtaatataaagttatacgtgtgaaagggaggtggacgacatgccggaacaattatccgtaagaaaatggagacttgtaagggacttgaaacagcaagaagtagcagatatattgggcgtcaatgcaaagacagttggtcattgggaaaaggatgacactaatttaagtaatgttacagtttacgctttagcaaagttatatgatattgaggtagaccagataaaggtctaaattttttgaccttcgtataactttttataacttttaggtaatgtaacaaatggacataaacaacttaaaaggaggaacaacaaatgaacgaagaaaaattaaagatgattctcttacttcttgaagatataccaagagacgaatggaatcgattagtaaatgaagtaaataatcaatacagttaccaagctgacaaggtaggacttgccagtgataactgtcaacaaatagcaaataactataagcactatggattttaagatggataaggactatcgttattcttttcacctttaacgttaatgtcgaaatacaaaacatgatctaaactgacaactctatcttttggatgaatgatgtgtagagttttgctttcagcatcttttatatgttcttgtactttaataacttcaccattaattaaatgtaaatctaaagaagtaacgatttctttatctaaatattgagtgagcaatctcttatgtatacttatcacctccttaggttgataacaacattatacacgaaaggtggaacaacaaatgaacaaaaaaatcagaagggttagacataatcataccaaggattttcagaagagatcatgcgtcagtagaatctttaacagaaaatgaacgtcgactaagaaaggaaatattaggaagtattaaaaaaggtgattacagctacttagaaataaacaaagttttctatgcattagatagagaacttcaatacagagcgaataataacaaactttaacatttatcgaaaggaaagatagaaatgccaaaaaatcatagtaccaccaacaccagaaaacacatatagaggcgaagaaaaatttgtgaaaaagttatacgcaacacctacacaaatccatcaattgtttggagtatgtagaagtacagtatacaactggttgaaatattaccgcaaagataatttaggtgtagaaaatttatacattgattattcaccaacaggcactctgattaatatttctaaattggaagagtatttgatcagaaagcataaaaaaatggtattaggaggatattaaatgagcgacacatataaaagctacttaatagcagtactgtgcttcacagtcttagcgattgtgcttatgccattgctgtacttcactacagcatggtcaattgcgggattcgcaagtatcgcaacattcatatactacaaagaatacttttatgaagaataaaaaaaactgctacttgcgtcaacaagtaacagtgacaaacatttatcaaaatatacaacttaattaaatcaaaatatacggaggtagtcaactatggctgaaaatattaaaactgaacaacattattacactaaagatttctcaggatacagaaatgaagaagataactttgtagcaaatcaagaattgacagtaacaatcacattgaacgagtacagaaaacttattgaaataaaggctgttaaagataaagaagaagatacttatagaggtaagtattttgaggaagaaagaaaaaaacgaaaaattggaaaaagaaaatataaaactaaaaaacaaaatttatgaattacaaaacgaagaagataaagaggaggacgaagaagacaaggaggacgagaaagatgtattacaaaattggtgagataaaaaataaaattatcagctttaacgggttcgaatttaaagtgtccgcgatgaagaggcatgatggtatcagtatacaaatcaaggatatgaataatgttccgtttaaatcatttcatgtcatagatttaagcgaactatatattgcaatggatgcaatacatgacgttgtaaatgaatggattgaagaaaacacagatgaacaggacaaactaatgaacttagtcatgaaatggtaggaggatttaatcaatggcaatattagaagatatttttgaagaattaaaactattaaataacaatttacgtgtgttaaacactgaactatcaacagtagattcatcaattgtacaagagaaagttaaagaagcaccaatgccaaaagaagaaacagctcaactggaatcaattgaagaagttaaggaaacttctgctgatttaactaaagattatgttttatcagtaggaaaagagttccttaaaaaaagcagatacttctgataagaaagaatttagaaataaacttaacgaacttggtgcggataagctatctactatcaaagaagagcattatgaaaaaaattgttgattttatgaatgcgagaataaatgcatgaagctagatcactcaaatagagctcatgcaaagcttagtgcaagtggagcaaaacaatggctaaactgcccaccgagtattaaggcaagtgaaggtattgcagataaaagtacagtttttgccgaagaaggtacattcgcccatgagttaagtgagttatatttcagccttaaatatgaaggcctaacacagtttgagtttaataaggcttttcaaaattataagagaaatcaatattacagcgaagaattgcgtgaatatgtggaagagtatgtagctaatgtagaagaaaaatataacgaagctttgagtagggataatgatgtaatagctttatttgaaacaaaattagatttaggtaaatacgtccctgaatcttttggaactggtgatgtcattatattttcaggtggtgtacttgaaattattgaccttaaatatggtaaaggcattgaagtttcagctatagataatcctcaacttagattatatggcttgggcgcatatgaactgcttagtttaatgtatgacattcatacaattcgcatgactatcatacaacctcgaatagataacttttctactgaagagttaccaatatcaagattacttcaatggggagccgattttgttaaaccattagccagacttgcttataacggtggaggagagtttaaagcaggtagtcattgtagattctgtaagataaatcattcatgtagaacacgtgcagaatacatgcaaaatgtgcctcaaaagccaccacatttgttaagtgatgaagagattgcagaacttttatataaactgcctgatatcaaaaaaatgggctgatgaagtagaacaatatgcactaaatcaagcgaaagaaaatgataaaaactatcctggttggaagcttgtagaaggtcgttcacgaagaatgataactgatacaaaagcaatgcttgaaaagttagttgaagcgggttataaacctgaagatattacagaaaccaagttacttagcattacgaatttagaaaaattaattggtaaaaaaagcattttctaaaattacagagggttttatagaaaagccgcaaggtaaattaacacttgctaccgagtcggataaacgaccagctataaagcaatctgctgaagatgattttgacaaactataaaaatttaaaaggacggtatataaacatgaaagcaaaagtattaaataaaactaaagtgattacaggaaaagtaagagcatcatatgcacatattttttgaacctcacagtatgcaagaagggcaagaatcaaagtattcaatcagtttaatcattcctaaatcagatacaagtacgataaaagccattgaacaagctatagaagctgctaaagaagaaggaaaagttagtaagtttggaggcaaagttcctgcaaatctgaaacttccattacgtgatggagatactgaaagagaagatgatgtcaattatcaagacgcttattttattaacgcatcaagcaaacaagcacctggtattattgaccaaaacaaaattagattaacggattctggaactgttgtaagtggtgattatattagagcttcaattaatctatttcctttcaacacaaatggtaataagggtatcgcagttggattgaacaacattcaacttgtagaaaaaaggcgaacctcttggcggtgcaagtgcagcagaagatgatttcgatgaattagacactgatgatgaggatttcttataagtcaataggtggggttttagccccactttaattttaaagaaattgaggtgtcaagaatttgagatttatgaatatagatattgaaacatatagcagtaatgatatttcgaaatgtggtgcctataaatacacagaagctgaagatttcgaaattttaattatagcttattcaatagatggtggagcgattagtgcgattgacatgactaaagtagataatgagcctttccacgctgattttgagacgtttaaaattgctctttttgatcctgctgtaaaaaaagtatgcattcaatgctaatttcgaaagaacttgtcttgctaaacattttaataaacagatgccacctgaagaatggatttgcacaatggttaattcaatgcgtattggcttacctgcttcgcttgataaagttggagaagttttaagactacaaaaccaaaaagataaagcaggtaaaaatttaattcgttatttctctataccttgtaaaccaacaaaagttaatggaggaagaacaagaaacttgcctgaacatgatcttgaaaaaatggcaacaatttatagattactgtattcgagatgtagaagtagaaatgacgattgctcataaaattaaagactttccagtaactgcaattgaacaagcatattgggtttttgaccaacatataaacgacagaggtattaagctttctaaatcattgatgttaggagctaatgtgctcgataagcagagtaaagaagaattgcttaatcaagctaaacatataacaggtttagaaaatcctaatagtcctacacaattattggcttggttaaaggatgaccaaggattagatatacctaatttacaaaagaaaacggttcaggagtacttaaaagaagcaacaggaaaagctaaaaaaaatgctagaaattagattgcaaatgtctaaaaccagtgtgaaaaaaatacaacaaaatgcatgacatgatgtgcagtgatgaacgggtaagaggtctgtttcaattttacggtgccggtactggaagatgggcaggtagaggtgtacaacttcagaatttaacaaagcattatatttcagatactgaattagaaatagcaagagatcttattaaagaacaacgttttgacgatttagatttattactcaatgttcatcctcaagacttattaagtcaattagttaggacgacatttactgctgaagaaggtaatgaactagcagtaagtgattttttctgcaatagaggcaagagtcatagcatggtatgcaaaagaacaatggcgtttagatgtgttcaacacacacggaaagatatatgaagcatcggcttctcaaatgtttaatgtcccggtagaaagcataactaaaggcgaccctctcagacaaaagggaaaagtgtccgaattagctttaggttatcaaggtggcgctggagctttaaaagcgatgggtgcattggaaatgggcattgaagaaaatgaattacaaggtttagttgatagttggcgtaacgcaaatcctaacatagttaatttttggaaggcttgccaagaggctgcaattaatactgtgaaatcccgaaagacgcatcatacgcatggacttagattttatatgaaaaaaggttttctaatgattgaactgcctagtggaagagctttagcttatccaaaagcttcagttggtgaaaatagttggggtagtcaagttgttgaatttatgggcttagatcttaaccgtaaatggtcaaagttaaaaacgtatggtgggaagttagtcgagaatattgttcaagcaactgcaagggatttacttgcgatttctatagctaggcttgaagcatcaggttttaaaatagttggacatgtccatgatgaagtaattgtagaaatacctagaggttcaaatggacttaaggaaatcgaaactatcatgaataagcctgtcgattgggcaaaaggattgaatttgaatagtgacggatttacttctccgttttatatgaaggattaggagtgtgattgaatgcaacatcaagcttatatcaatgcttctgttgacattagaattcctacagaagtcgaaagtgttaattacaatcagattgataaagaaaaagagaatttggcggactatttatttaataacccaggtgaactattaaaatataacgttataaatatcaaggttttagatttagaggtggaatgatggctagaagaaaagttataagagtgcgtatcaaaggaaaactaatgacattgagagaagtttcagaaaaatatcatatatctccagaacttcttagatacagatacaaacataaaatgcgcggcgatgaattattgtgtggaagaaaagactcaaaatctaaagatgaagttgaatatatgaagagtcaaataaaagatgaagaaaaagagagagaaaaaatcagaaaaaaaagcgattttgaacctataccaacgaaatgtgagagcggaatatgaagaagaaagaaagagaagattgagaccatggctttatgatggaacgcctcaaaaacattcacgtgatccgtactggttcgatgtcacttataaccaaatgttcaagaaatggagtgaagcataatgagcataatcagtaacagaaaagtagatatgaatgaaacacaagacaatgttaaacaacctgcgcattacacatacggcgacattgaaattatagatttcatcgaacaagttacggcacagtatccaccacaattagcattcgcaataggtaatgcaatcaaatacttgtctagagcaccgttaaagaatggtcatgaggatttagcaaaggcgaagttttacgtcgatagagtgtttgacttgtgggaggggtaacgatggcaacgcaaaaacaagttgattacgtaatgtcattacaggagcaactggaattagaagactgcgaaaaatatacagacgaacaagttaaagcaatgagtcataaagaagttagcaatgtgattgagaactataagacaagcataaggaatgaagaactatattacgaatgcatgtcgtttggactgcctaattgttaaaaggagtgacgaccatgacagatagcgcacgtaaagaacgcttaaaccaattttttcggctctaaaagatatctgtatcaggataacgaacgagtggcacatactcatgtagtaaatggcacgtattactttcatgggcatatcgtgccaggttggcaaagcgttaaaaagacatttgatactgctgaagagctcgaaatatatataaagcaacatggtttggaatacgaggaacagaagcaactaactttattttagaggagatggaaatgatgaataaccgcgaacaaattgaacaatcaattatcagtgctagtgcgtataacggcaatgacacagagggattactaaaagagattgaagacgtgtataagaaagcgcaagcgtttgatgaaatacttgaaggtttacctaatgctatgcaagatgcactcaaagaagatattggtcttgatgaagcagtagggattatgacggggcaagtggtctataaatatgaggaggagcaggaaaatgaagaaatttaatgttcaaatcacatataccggcatgattgaagagactatcgaggctgaaagtttagaagaagcagaatttgaggcggatgttattgcgagattggaagcgccatttgattgtgatgagtatgaaattaatgtagaggaggaacaggaaaatgactaacacattacaagtgaaactattatcaaaagacgctagaatgcccgaacgaaatcataagacggatgcaggttatgacatattctcagccgaaaccgtcgtactcgagccacaagaaaaggcagtgatcaaaacagatgtagccgtaagcataccagagggctatgtcgggctgttaactagccgtagtggtgtaagtagtaaaacacatttagtgattgaaacaggcaagatagatgcgggatatcatggcaatttagggattaatatcaagaatgatgcacaagtatatttaacaactaacgaacagtgttttgatatacaaggagaaatggaaaattcttttgtaaataatgctaagaaaaaaccttttactataaatgattattacgaaatatataaaggcgacaaactagcacaactggttatcgtacctatatggacacctgaactaaagcaagtggaggaattcgagagtgtttcagaacgtggagcaaaaggcttcggaagtagcggagtgtaaagacatcttagatcgagtcaaggaggttttggggaagtgagagaacgcactaaaattatatatcgtggttggaataaggagatatttattttacagggtaaaaatatgaatgttattggtttgcgccaaatatttgatgaactcaaaagatcgtatgaaggttataaaatcgttgttattccaatagaagttgattttgaaatcaaataaataggagtgatgagaagtgacacaatacttagtcacaacattcaaagattcaacaggactaccacatgaacatattactgtggctagagataatcagacatttacagttgttgaggcagagagtaaagaagaagcaaaagagaagtacgaggcgcggaacgtgccagttgatggagcaaccaacttaaacgatatcaaatcaaatattggtatctttcatgttgaaaaagtcgaaccaaacgagggtatggtggacattaacattgagacaatgaaaccattcgaggaggcagatgatgattaacatacctaaaatgaaattcccgaaaaagtacactgaaataatcaaaaaaatataaaaataaaacacctgaagaaaaagctaagattgaaaatgattttattaaagatattaatgataaagacagtgaattttacagtcctatgatggctaatatgaatgaacatgaactaagggctatgttaagaatgatgcctagtttaattgatactggagatgacaatgatgattaaaaaacttaaaaatatgaattggttcgatatctttattgctggaatactgcgattattcggcgtaatcgcactgatgcttgttgtcatatcgcctatctatacagtggctagttaccaaaacaaagaagtacatcaagggacaattacagataaatataacaagagacaagataaagaagacaagttctatattgtattagacaacaaacaagtcattgaaaactccgacttattattcaaaaagaaatttgatagcgcagacatacaagctaggttaaaagtaggcgacaaagtagaagttaagacgattggatatagaatacactttttaaatttatatccggtcttatacgaagcaaagaaggtagataaacaatgattaaacaaatattaagactattattcttactagcaatgtatgagctaggtaagtatgtaactgagcaagtatatattatgatgacggctaatgatgatgtagaggcgccgagtgacttcgcaaaaatcagagctgaagtttcatggtaatagctattatcatttttgaattaattatattaatgtgtttagcaatagcactggaggtgttgtaaatatgtggattgtcatttcaattgttttatctatatttttattgatcttgttaagtagcgtttctcataagatgaaaaccatagaagcattggagtatatgaatgcttatcttttcaagcagttagtaaaaaaataatggtgttgaaggtttagaagattatgaaaatgaagttgaacgaattagaaaaagattcaaaagctaaagagaggcgttggcttctctgctctatctaaaataatgaaaggagccgaacatgttagacaaagtcactcaaatagaaacaattaaatatgatcgtgatgtctcatattcttatgctgctagtcgtttatccacacattggactaatcacaacatggcttggtctgactttatgcagaagctagcacaaactgttagaactaaagaagatttaactgagtacaataaaatgtctaagtctgaacaagccgatataaaagatgttggcggatttgtcggcggatatttaaaagaagggaaacggcgtgctggtcaagtcatgaatcgttcaatgttaacacttgatatcgattatgctgctcaagatatgacggacatattatctatgttttatgattttgcatattgtttatattcaacacataagcatagagagataagtccaagactgcgtttagtgattcctttaaaacggaatgtaaatgcagatgagtatgaagctattggacgtaaagtggcagatatcgttggcatggattacttcgatgatacaacttatcaaccacataggttaatgtattggccttcaactagcaatgatgcagaatttttctttacctatgaagatttacctttgttagacccagataaaatattaaatgaatatgttgattggactgacacattagaatggccaacgtcttcaagggaagagagtaagactaaaagattagcagataagcaaggcgacccagaagaaaagccgggaattattggtgcattttgtagagcctatacgatagaagaagctatagaaacttttattcctgacttatacgaaaaacattctactaaccgatatacctatcatgaaggctcaactgcaggtggattggtgttatacgaaaacaacaagtttgcctattctcatcataatacggatcccgtaagcggtatgcttgtgaacagttttgatttagtacgcatacacttatatggtgctcaagatgaagaaactaaaacagatactccggttaatcgactacctagttataaagcaatgcagcaaagagcgcaaaatgatgaagttgttaaaaaagcaattaattaatgacaaaatgtctgatgcaatgcaggatttcgatgaaatagaaaatagcgatgatgcatggtctgaaacgttagaaattacttcgaaaggtactttcaaagctagtatcccaaatatagaaattatattgcgtaatgatccaaatttaaaaggaaaaatagcctttaacgaatttacgaaacaaattgaatgtttagggaaagtgccatggaatactaattttaagacacgtcaatggcaagacggtgatgatagcagtttaagaagttatatcgaaaagatttatgacatacaccattcaggcaaaacaaaagatgccattataagcgtagcaatgcaaaatgcctatcatccagtaagagattatctaaataaaatatcgtgggatggacataaacgtcttgaaaagttatttatcaaatacttaggtgttgaagacactgaagtgaatagaacaactaccaaaaaggcattgactgctggaatcgctcgagtaatggagccaggatgtaaatttgactatatgcttacactttatggtcctcaaggtgtaggtaaatctgctttgctaaaaaaaattaggtggtgcatggttttctgacagtttagtttctgttacaggtaaagaagcttatgaggccttacaaggcgtttggctaatggaaatggcagaacttgcagctacaagaaaagctgaagttgaagctattaagcatttcatatctaaacaagttgaccgatttcgtgttgcttatgggcattatattgaagattttccaaggcaatgtattttcattggtacaactaataaagttgatttcttaagagatgaaactggtggaagacgtttttggccaatgactgtaaatccagagagagttgaagtgaactggtctaaactaaccaaagatgagattgaccaaatatgggcagaagctaaatactattatgaacaaggagaagagttgttccttaaccctgaactagaagaagaaatgcgttcaatccaaagtaaacatactgaggaatctccatatacaggtattattgatgaatatcttaacacgccaatcccaagcaattgggaagacttgagcatctttgaaagaagacgattttatcaaggtgatgttgatatgttaccaacaggaaatgtagattacgttgaaagaaataaggtctgtgcgcttgaagtgtttgttgaatgttttggtaaggataagggagatagtagaggatctatggaaattagaaagatttcaaacatcttaagacaattagacaattggtctgtatatgatggtaataaaagtgggaaaattcgattcggaaaagattatggtgtacagatagcgtatgtaagagatgaaagtttagaggatttaatataagaaatattgaataaatatacatttttagatgttgtatcaaatgttgcatcatttttttgagtgatgcaacacggtggtgtaaaaagtaatcttaggtgttgtatcatttttggtgatgcaacattgatgcaacaaatgatacaacacctctttcccttctcgctgtagggttcaaccctgtttgtttccaatgttgcatcaaattcactataaagtttaaaaagtagtgttagggagtaaaggggtataggggtaaccctctaacagctatttttaaaagtttggcaagaattgatgcaacattggaacacaaatataaattttgtatacaaggtgaatatatgaaagagtcgacattagaaaaatatttagttaaagagataacaaagctaaacggtttatgtttaaaatgggttgcacctggaacaagaggtgtaccagatagaattattattatgccagaaggaaaaacattttttgtagaaatgaagcaagaaaagggaaagttgcatcctttacaaaaaatatgtgcatagacaatttgaaaacagagatcatacagtatatgtgttatggaataaagaacaagtaaatacttttataagaatggtaggtggaacatttggcgattgacttcaaaccacatagctatcaaaagtatgcaatagataaagttattgataatgagaaatacggtctattttttagatatgggactagggaaaacagtgtcaacacttacagcatttagtgaattgcagttgttagacactaaaaaaaatgttagtcatagcaccaaaacaagttgctaaagatacatgggttgatgaagttgataagtggaaccatttaaatcatctgaaagtgtctttaatcttaggaacacctaaagaaagaaatgatgcattaaacacagaggctgatatctatgtaaccaataaagaaaatactaaatggttatgtgatcaatataaaaaaagaatggccatttgacatggttgtaattgatgaactgtctacatttaaaagtcctaagagtcaaaggtttaaatctattaaaaagaaattaccactcattaatagatttataggattaacaggaacacctagtccaaatagtttacaggatttatgggctcaagtttatttgatagacagaggcgaaagacttgagtcttcattcagtcgttatcgagaaaggtactttaaaccaacacatcaagttagcgaacatgtttttaactgggagctaagagacggatctgaagaaaagatatatgaacgaatagaagatatatgtttaagcatgaaagcgaaagattatctggatatgcctgacagagttgatactaaacaaacagtagtcttatctgaaaaagaaagaaaagtatatgaagaattagaaaaaaactatattttagaatcggaagaagaaggaacagttgtagctcagaatggggcatcattaagtcaaaaactacttcaactagctaacggtgcagtttatacagatgatgaagatgtaagacttatacatgataagaagttagataagttagaggaaattatagaggagtctcaaggccaaccaatattattgttttataacttcaaacatgataaagaaagaatacttcaaaggtttaaggaagcaaccacattagaggattcaaactataaagaacgttggaatagtggagacattaagctgcttatagcacatccagcaagtgcagggcatggattaaacttacaacaaggtgggcacattattgtttggtttggacttacatggtcattggaattataccaacaagcaaatgcaagattatatagacaaggacaaaatcatacgactattattcatcacatcatgaccgataacacaatagatcaaagagtatataaagctttacaaaataaagaactaacgcaagaagaattaatgaaagctattaaagcaagaatagctaagcataagtaatggaggtctaacatggggaacacaatatatgatatcaagccaggaacatttaaatatattgaatcagaaatatataatttaaatgagaacaagaaagaaataaaaagattgaggttggaaatacttaatccaacgaaggaacaagattccaatattgtatatggaccattacaaaaaggcgaaccagttagaacaactgaactaatggcaactagattattaactaataagatgttacgaaaccttgaagaaatggtcgaagcagttgagagtgaatacttaaagttgcctgaagatcataagaaagtaataaggctcaagtattggaataaagaaaagaagttaaagatggaacagataggacatgaatgccatatgcatcgtaatactgttactactatacgaaagaactttgttaaagcggtagcgtatcatgcaggtatcaaataacattgtgcaaagattgtgcaaaaggcctacaaatctgtagtaatatgatagtatcggaaagatgtataaagttatctaaaagttatacgacataagtaaacgaggcacatcgctatgcggtgtgtcttttgttatgcaatcaaagaggtgtaagagatgaccaagcataataacatttataagcatggtcgtaagtcatatcaatacgattggttctatcattcaaaagcatggaagaagttaagagagatagcattagatagagataattatctttgtcaaatgtgtttacgcgaagatattgtaacagatgcaaacattgtacatcacattatttatgttgatgaagattttaacaaagctttagacttagataatctaatgtcagtttgttatagctgtcataacaaaattcatgcaaatgataatgacaaaagtaatcttaagaaaattagagttctaaaaaatttaaataaaaaaattatttaaataaaattttatgcccccctgcccatcggcttaaaatgttttttcgccgggtaccggagaggcccaaacgctagcaacgcggataaatttttcatgaaagggggtctttatatgaagttaacaaaaaaaacaagctaaaagaatatatagaagattacaaaaaaatctgatgacatattaattaatttgtatatagaaacatatgaattttattgtcggttaagagatgaacttaaaaatagtgatttaatgatagagcatacaaacaaggctggtgcgagcaatattattaagaatccattaagcatagaactgacaaaaacagttcaaacactaaataacttactcaagtctatgggtttaactgcagcacaaagaaaaaagatagttcaagaagaaggtggattcggtgactattaaagttttaaatgaaccttcaccaaaactattaacaacatggtatgcagagcaagtcactcaagggaaaataaaaacaagcaaatatgttagaaaagaatgtgagagacatcttagatatctagaaaatggaggtaaatgggtatttgatgaagaattagcgcatcgtcctattcgatttatagaaaagttttgtaaaccttccaaaggatctaaacgtcaacttgtattacagccatggcaacattttattatcggcagtttgtttggttgggttcataaagaaacaaaactgcgcaggtttaaagaagctttgatatttatggggcgaaaaaaatggtaaaacaaccactatttctggggttgctaactatgctgtatcacaagatggagaaaatggtgcagaaattcatttgttagcaaacgtaatgaaacaagctaggattctatttgatgaatctaaggcgatgattaaagctagcccaaagcttgataaaaatttcagaacattaagagatgaaatccattatgacgcaacgatatcaaaaattatgccccaagcatcagatagcgataagttagatggattgaatacacacatggggattttttgatgaaattcatgaatttaaagactataaattgatttcagttataaaaaactcaagagctgcaaggttacaacctcttctcatctacattacgacagcagggtatcaattagatggtccacttgttgatatggtagaagcgggaagagacaccttagatcaaatcatagaagacgaaagaacttttttattatttagcatctttggatgatgacgatgatattaatgattcgtcgaactggataaaagcaaatcccaacttaggtgtctctataaatttagatgagatgaaagaagagtgggaaaaagctaagagaacaccagctgaacgtggagattttataaccaaaaggtttaatatctttgctaataatgacgagatgagttttattgattacccaacactccaaaaaaaataatgaaattgtttctttagaagagctggaaggcagaccgtgcacgattggttatgatttatcagaaacagaggactttacagccgcgtgtgctacttttgcgttagataatggtaaagttgcagttttatcgcattcatggattcctaagcacaaagttgaatattctaacgaaaaaataccctatagagaatgggaagaagatggcttattaacagtgcaagataagccttatattgactaccaagatgttttaaattggataattaagatgaatgagcattatgtagtagaaaaaattacttatgatagagcgaacgcattcaaactaaatcaagagttaaaaaaattacgggtttgaaacggaagaaacaagacaaggagctttgaccttgagccctgcattgaaggatttaaaagaaatgtttttagatgggaaaataatatttaataataatcctttaatgaaatggtatatcaataatgttcagttgaaactagacagaaacggaaactggttgccgtctaagcaaagcagatatcgtaaaatagatggctttgcagcatttttaaacacatatacagatattatgaataaagttgtttctgatagtggtgaaggaaacatagagtttattagtattaaagacataatgcgttaaggaggtgaatgttatcgcaaaagagaatattgtcacacgcataaagaaaaaattgatagacaattggattgatcagtcaacttctaagctttatgactttagcccatggaaaaatagatctttttggggtgtaattaataatacgcttgaaactaatgaaacgatattttcagctattacaaagttatctaattcgatggctagtttgcccttgaaaatgtatgaagattataaagtagttaatacagaagtatctgatttacttacagtgtcaccgaataattctctgagcagttttgattttattaatcaaattgaaacaatcagaaatgaaaaaggtaatgcatatgtgctaattgaacgagacatctatcatcaaccatcaaagcttttcttattaaatccagatgttgttgaaatgttaattgaaaaccaatcacgtgaactttattattccattcatgctgcaactggaaataaattgattgttcataatatggacatgttgcattttaaacacatcgtggcatctaatatggtgcaaggcattagtccgattgatgtgttgaagaatacaactgattttgataatgcagtaagaacctttaatcttacagaaatgcaaaaaacctgattctttcatgcttaaatatggttccaatgtaggtaaagaaaaaaaggcagcaagtgttagaagatttcaaacagtactatgaagaaaacggtggaatattattccaagagcctggtgttgaaatcgaaccgttacctaaaaaaatatgtctctgaagatatagtggcaagcgagaatttaacaagagaaagagtagctaacgtttttcaattgccctcagtattcttaaatgcaagatcaaatacaaatttcgcgaaaaaatgaagagttaaacagattttacttgcagcataccttattgccaatcgtcaaacagtatgaagaagaatttaatcggaaactacttactaaaacagacagagaaaaaaataggtattttaaatttaacgttaaatcttatttaagggctgatagtgcaacacaagcagaagtgtactttaaagcagttcgtagtggttactacactataaatgacattagagagtgggaagatttaccaccagttgaaggtggagataagccgctaataagcggtgatttatacccaattgacacgccacttgaattaagaaaatctttgaaaggtggtgataaaaatgtcaatgaaagctaagtattttcaaatgaaaagaaaatcaaaaagtaaaggtgaaatatttatttatggtgatattgtaagtgataaatggtttgaaagtgatgtaactgctacagatttcaaaaataaactagatgaactaggagacatcagtgaaatagatgttcatataaattcatctggaggcagtgtatttgaagggcatgcaatatacaatatgctaaaaaatgcatcctgcaaaaattaatatctatgtcgatgccttagcggcatcaattgctagtgttatcgctatgagtggtgacactatttttatgcacaaaaatagttttttaatgattcataattcatgggttatgactgtaggtaatgcagaagaattaagaaagacagcggatttacttgaaaaaacagatgctgttagtaattcagcttatttagataaagcaaaagatttagatcaagaacacttaaaacagatgttagatgcagaaacttggcttactgcagaagaagccttgtctttcggcttgatagatgaaattttaggagctaatgaaatagctgctagtatctctaaagagcaatataagcgtttcgagaacgtcccagaagatttaaagaaagatgtagacaaaatcactaaaattgatgatgtagatacatctgaattggttgaaacacctaaagaaagtatgtcactagaagaaaaaagaaaaaaagagaaaaaaattaaacgcgaatgcgaaattttaaaaaatgacaatgaattattaggaggaaatgaaatgccgacattatatgaattaaaacaatccttaggtatgattggacaacaattaaaaaaataaaaaatgatgaattgagtcagaaagcaacagatccaaatattgatatggaagacatcaaacaactagaaacagaaaaagcaggtttacaacaaagatttaacattgttgaaagacaagtgcaagacattgaagagaaagaaaaagcgaaagttaaagataaaggagaagcttatcaatctttaagtgataatgagaagatggttaaagctaaggcagagttttatcgtcacgcgattttaccaaatgaatttgaaaaaccttcaatggaggcacaacgtttattacacgctttaccaacaggaaatgattcaggtggagataagctcttaccaaaaacactttctaaagaaattgtttcagaaccatttgctaaaaaccaattacgtgaaaaagctcgtctaactaacattaaaggtttagagattccaagagtttcatacactttagacgatgatgatttcattacagacgtagaaacagcaaaagaattaaaagcaaaaggtgatacagtcaagttcactactaataaattcaaagtatttgctgcaatttcagatactgtaattcatggatcagatgtagatttagtaaactgggttgaaaacgcactacaatcaggattagcagctaaagagcgtaaagatgccttagcagtaagtcctaaatctggattagaacacatgtcattttataatggatctgttaaagaagttgagggagcagacatgtatgatgctattattaacgctttagcagatttacatgaagattatcgtgataacgcaacaatttatatgcgatatgcagattatgtcaaaattattagtgttctttcaaatggaacaacaaatttctttgacacaccagcagaaaaagtatttggcaaaccagtagtatttacagatgcagcagttaaacctattgtgggagatttcaattattttggaattaactatgatggaacaacttatgacactgataaagatgttaaaaaaaggcgaatatttgtttgtattaacagcatggtatgatcagcaacgtacattagacagtgcattcagaattgcaaaagcaaaagaaaatacaggtccattacccagctaagccccaaaaggttaatgtaacagctaaggctaaatcagctgtaatatcagccgaataggggtgatgaaatgagtttagaagaaattaaattgtggttgagaattgactataatttcgaaaatgatttaattgaaggtctcattcaatcggctaagtctgaattactattaagtggggttccagattatgacaaagatgacttggaatacccgctttttttgtacagcgattaaatatatcattgcaagagattatgaaagtcgtggatactcaaatgaccaatctagaagcaaggtgtttaatgaaaaaaggattgcaaaaaaatgattttgaaattaaaaaaagtggtaggtgatttttaaatggaatttaatgaatttaaagatcgcgcgtattttttttcaatatgtaaataaagggccgtatccagatgaagaggaaaaaaatgaaattgtatagttgcttttgtaaaatatataatccttctatgaaagatagagaaattttaaaagcgactgaatcaaagtcaggactaaccataattatgaggtcttctaaaattgaatatctaccacaaacaaatcacttagttaaaattgacagaggcttatattccgataaattattcaacattaaagaaataagaattgatacaccagatattggctataatacagtggttttatcagaaaaatgagtgtagaaattaaagggatacctgaagtgttgaagaaattagaatcggtatacggtaaacaatcaatgcaagctaagagtgatagagctttaaatgaagcatctgaatttttttataaaggctttaaagaaagaattcgagagttttaaagatacgggtgctagcatagaagaaatgactaaatctaagccttatacaaaagtaggaagtcaagaaagagctgttttaattgaatgggtaggccctatgaatcgcaaaaacattattcacttgaatgaacatggttatacaagagatggaaaaaaaatatacaccaagaggttttggagttattgcaaaaacattagctgctaatgaacggaagtatagagaaattataaaaaaggagttggccagataaatgaatatattaaacaccataaaaggaattttattatctgatgcagagctcaaaacacatataaattctagaatatactattacaaagtcactgaaaacgctgaaacttccaagccctttgttgttattacacctgtttatgatttgccttcagactttatgtctgataaatatctcagtgaagaatacttaattcaaatagatgtagaatcttcaaataatcagaaaacaattgatataacaaaacgaataagatacctgttatatcaacaaaatttaattcaagcatctagtcagttagatgcttattttgaagaaactaaacgttatgtgatgtcgagacgatatcaaggcatacccaaaaatatatattataaaaatcagcgcatcgaataggtgtgcttttttaatttttaaggaggaaataagcaatggcagaaggacaaggttcttataaagtaggttttaaaagattatacgttggagtttttaacccagaagcaacaaaagtagttaaacgcatgacatgggaagatgaaaaaggtggtacagttgacctaaatatcacaggtttagcaccagatttagtagatatgtttgcatctaacaaacgtgtatggatgaaaaaacaaggtactaatgaagttaagtctgacatgagtattttcaatattccaagtgatgatttaaacacagttattggacgtactaaagataaaaaatggtacatcttgggtaggagagaatacaagagcaccgtatgtaacagtaattggcgaatcggaagatggtttaacaggtcagccggtatatgtagccttacttaaaggtacttttagtttagattcaattgaatttaaaacacgaggtgaaaaagcagaagccccagaacctacaaaattaacaggtgactggatgaatagaaaagttgatgttgatggaacgtcacaaggtattgtatacggttatcatgaaggtaaagaaggagaaacagaattcttcaaaaaaagtattcgttggatacacggacagtgaagatcattcagaggattctgcaggttcgttacccagctaatccccaaaatgttgaagtagcagttaattcaaaatctgcaacagtttcagcagaataggggctttcaaaataaatcaaaggagaataatttatgactaaaactttaaaggtttataaaggagacgacgtcgtagcttctgaacaaggtgaaggcaaagtgtcagtaactttatctaatttagaagcggatacaacttatccaaaaggtacttaccaagtggcatgggaagaaaatggtaaagaatctagtaaagttgatgtacctcaattcaaaaccaatccaattctagtctcaggcgtatcatttacacccgaaactaaatcaatcacggtaaatgctgatgacaatgttgaaccaaacattgcaccaagtacagcaacgaataaaacgttgaaatatacaagtgaacatccagagtttgttactgttgatgagagaacaggagcaattcacggtgtagctgagggaacttcagttatcactgctacgtctactgacggaagtgacaagtctggacaaattacagtaacagtaacaaatggataattatttgagacgcagaatatctgcgtctttttttatttgaataaaaggagctaatacaatgattaaatttgaaattaaagaccgtaaaacaggaaaaacagagagctatacaaaagaagatgtgacaatgggcgaagcagaaaaatgctatgagtatttagaattagtaaatcaagagaataaaaaagaagcacctaacgcaacaaaaatgagacaaaaagagcgacagttattagtagatttatttaaagatgaaggattgactgaagaagatgttctgaacaagatgagtactaaaacttatacaaaagccttacaagatatatttcgagaaatcaatggtgaagatgaagaagattcagaaactgaaccagaagagatgggaaagacagaagaacaatctcaataaaagacattttatcgaatattaagaaaatacaacgtttctgtatggagcagtatgggtggacattaactgaagtcagaaaacagccgtatgtaaaacttttagaaatacttaatgaagagaataaagaagagactgaagaaaaaacaaagtgaacaaaaagtcattacaggtacggatttaagaaaactttttggaagctagaaaggaggttaatatgaatgaaaaagtagaaggcatgaccttggagctgaaattagaccatttaggtgtccaagaaggcatgaaaggtttaaagcgacaattaggtgttgttaatagtgaaatgaaagctaatctgtcagcatttgataagtctgaaaaaatcaatggaaaaaatatcaggcgagaattaaggggttaaatgataggcttaaagttcaaaaaaaagatgtattctcaagtagaagatgagcttaaacaagttaacgctaattaccaaaaagctaaatccagtgtaaaagatgttgagaaagcatatttaaagttagtagaagccaataaaaaaagaaaaattagctcttgataaatctaaagaagccttaaaatcatcgaatacagaacttaaaaaaagctgaaaatcaatataaacgtacaaatcaacgtaaacaagatgcgtatcaaaaacttaaacagttgagagatgcagaacaaaagcttaagaatagtaaccaagctactactgcacaactaaaaagagcaagtgacgcagtacagaagcagtccgctaagcataaagcacttgttgaacaatataaacaagaaggcaatcaagttcaaaaaactaaaagtgcaaaatgacaatctttcaaaatcaaatgataaaattgaaagttcttacgctaaaactaatactaaattaaagcaaacagaaaaaagaatttaatgatttaaacaatactattaagaatcatagcgctaatgtcgcaaaagctgaaacagctgttaataaagaaaaagctgctttaaataatttggagcgttcaatagataaagcttcatccgaaatgaagacttttaataaagaacaaatgatagctcaaagtcatttcggtaaacttgcaagtcaagcggatgtcatgtcaaagaaatttagttctattggagacaaaatgacttccctgggacgtacaatgacgatgggcgtatctacaccaattactttagggttaggtgcagcattaaaaacaagtgcagactttgaaggccaaatgtctcgagttggagcgattgcgcaagcaagcagtaaagacttgaaaagcatgtctaatcaagcagttgacttaggagctaaaaccagtaaaagtgctaacgaagttgctaaaggtatggaagaattggcagctttaggctttaatgccaaacaaacaatggaggctatgccaggtgttatcagtgcagcagaagcaagtggtgcagaaatggctacaactgcaactgtaatggcttcagcgattaactctttcggtttaaaagcatctgatgcaaatcatgttgctgatttacttgcgagatcagcaaatgatagtgctgcagatattcagtacatgggagatgcattgaagtatgctggtactcctgcaaaagcattaggagtttcaatagaggacacttccgcagcaattgaagttttatctaactcaggtttagagggttctcaagcaggtactgccctaagagcttcatttatcaggctagctaatccaagtaaaaatacagctaaggaaatgaaaaaattaggtattcatttgtctgatgctaaaggtcaatttgttggcatgggtgaattgattagacagttccaagataatatgaaaggcatgacgagagaacaaaaactagctacagtggctacaatagttggtactgaagcagcaagtggatttttagccttgattgaagcgggaccagataaaattaatagctatagtaaatccttaaagaattccaatggcgaaagtaaaaaaagcagcagatttgatgaaagataatctcaaaggcgctctggaacaattaggtggcgcttttgaatcattagcaatcgaagtcggtaaagatttaacgcctatgattagagcaggagcggaaggtttaacaaaattagttgatggatttacacatctccctggttgggttagaaaagcttcagtaggattagcactttttggtgcagcaattggacctgcagttcttgctggagggttattaatacgtacagttggaagtgctgctaaaggatatgcgtcattaaatagacgtattgctgaaaatacaatcctttcaaatactaattcaaaagcaatgaaatctttaggtcttcaaacattatttcttggttctacaacaggaaaaacgtcaaaaggctttaaagggttagccggagctatgatgtttaatttaaaacctataaatgttttgaaaaattctgcaaagctagcaattttaccgttcaaacttttgaaaaacggtttaggattagctgcaaaatctttatttgcagtaagtggaggcgcaagatttgcgggtgtagccttaaggtttttaacaggacctataggtgctacaataactgctattacaattgcgtataaagttttttaaaaccgcatatgatcgtgtggaatggttcagaaacggtattaacggtttaggagaaactataaagttttttggtggtaaaattattggcggcgctgttagaaagctaggagagtttaaaaaactatcttggaagtatcggcaaaagcttcaaagaaaagttttcaaaagatatgaaagatggttataaatcattaagcgacgatgaccttctcaaagtaggagtcaacaagtttaaaggatttatgcaaaccatgggcacagcttctaaaaaaagcgtctgatactgtaaaagtgttagggaaaggtgtttcaaaagaaacagaaaaagctttagaaaaatatgtgcattattctgaagaaaatagcagaatcatggaaaaagtacgtttaaactcgggtcagatatcagaagacaaagcaaaaaaaacttttgaaaattgaaacggatttatctaataaccttatagctgaaatagaaaaaaagaaataaaaaggaactcgaaaaaaactcaagaacttattgataagtatagtgcattcgatgaacaagaaaagcaaaacattttaactcgaactaaagaaaaaaaatgacttgcgaattaaaaaaagagcaagaactcaatcagaaaatcaaagaattgaaagaaaaaagctttgagtgatggtcagatttcagaaaatgaaagaaaagaaattgaaaagcttgaaaatcaaagacgtgatatcactgttaaagaattgagtaagactgaaaaagagcaagagcgtattttagtaagaatgcaaagaaacagaaatgcttattcaatagacgaagcgagcaaagcaattaaagaagcagaaaaagcaagaaaagcaagaaaaaaagaagtggacaagcaatatgaagatgatgtcattgctataaaaaataacgtcaacctttctaagtctgaaaaagataaattgttagctattgctgatcaaagacataaagatgaagtaagaaaagcaaaatctaaaaaagatgctgtagtagatgttgttaaaaaagcaaaataaagatattgataaagaaatggatttatccagtggacgtgtatataaaaaatactgaaaagtggtggaatggccttaaaagttggtggtctaactttagagaagaccaaaagaaaaaaaagcgataaatacgctaaagaacaagaagaaacagctcgtagaaacagagaaaatataaagaaatggtttggaaatgcttgggacggcgtaaaaagtaaaactggcgaagcctttagtaaaatgggcagaaatgctaatcattttggcggcgaaatgaaaaaaaatgtggagcggaatcaaagggattccaagcaaattaagttcaggttggagctcagccaaaagttctgtaggataccacactaaggctatagctaatagtactggtaaatggtttggaaaagcttggcaatctgttaaatcgacaacaggaagtatttacaatcaaactaagcaaaagtattcagatgcttcagataaagcttgggcgcattcaaaatctatttggagaggcacatcaaaatggtttagcaatgcatataaaagtgcaaagggctggctaacggatatggctaataaatctcgcgcgaaatgggataatatttctagtacagcttggtcgaatgcaaaatccgtttggaaaggaacatcgaaatggtttagtaactcatacaaatctttaaaagattggactggggatatgtattcaagagcccacgatcgttttgatgcaatttcaagttcggcatggtctaacgctaaatcagtatttaatggttttagaaaatggctatccaaaacatatgattggattagagatattggtaaagacatgggaagagctgcggctgatttaggtaaaaatgttgctaataaagctattggcggtttgaatagcatgattggcggtattaataaaatatctaaagccattactgataaaaatctcatcaagccaatacctacattgtctactggtactttagcaggaaagggtgtagctaccgataattcgggagcattaacgcaaccgacatttgctgtattaaatgatagaggttctggaaacgccccaggtggtggagttcaagaagtaattcacagggctgacggaacattccatgcaccccaaggacgagatgtggttgttccactaggagttggggatagcgtaataaatgctaatgacactctgaagttacagcgtatgggtgttttaccaaagtttcatggaggtacgaaaaagaaagattggctagaccaacttaaaggtaatataggtaaaaaagcaggagaatttggagctacagctaaaaacacagcgcataatatcaaaaaaaggtgcagaagaaatggttgaagcagcaggcgataaaatcaaagatggtgcatcttggttaggcgataaaatcggcgatgtgtgggattacgtacaacatccagggaaactagtaaataaagtaatgtcaggtttaaatattaattttggaggcggagctaacgctacagtaaaaatagctaaaggcgcatactcattgctcaaaaaagaaattagtagacaaagtaaaatcgtggtttgaagatttcggtggtggaggcgatggaagctatctatttgaatatccaatctggcaaagatttggacgctacacaggtggacttaactttaatggcggtcgtcactatggtatagactttggtatgccttctggaacaaacgtttatgccgttaaaggtggtatagcagataaggtatggactgattacggtggcggtaattctatacaaattaagactggtgctaatgaatggaactggtatatgcatttatctaagcaattagcaagacaaggccaacgtattaaagctggtcaactgatagggaaatcaggtgctacaggtaatttcgttagaggagcacacttacatttccaattgatgcaagggtcacatccagggaatgatacagctaaagatccagaaaaatggttgaagtcacttaaaggtagtggcgttcgaagtggttcaggtgttaataaggctgcatctgcttgggcaggcgatatacgtcgtgcagcaaaacgaatgggtgttaatgttacttcgggtgatgtaggaaatattattagcttgattcaacacgaatcaggaggaaatgcaggtataactcaatctagtgcgcttagagacatcaacgttttacagggcaatccagcaaaaggattgcttcaatatatcccacaaacatttagacattatgctgttagaggtcacaacaatatatatagtggttacgatcagttattagcgttctttaacaacagatattggcgctcacagtttaacccaagaggtggttggtctccaagtggtccaagaagatatgcgaatggtggtttgattacaaagcatcaacttgctgaagtgggtgaaggagataaacaggaaatggttatccctttaactagacgtaaacgagcaattcaattaactgaacaggttatgcgcatcatcggtatggatggcaagccaaataacatcactgtaaataatgatacttcaacagttgaaaaaattgttgaaacaaattgttatgttaagtgataaaggaaataaattaacagatgcattgattcaaactgtttcttctcaggataataacttaggttctaatgatgcaattagaggtttagaaaaaatattgtcaaaacaaagtgggcatagagcaaatgcaaataattatatgggaggtttgactaattaatgcaatcttttgtaaaaatcatagatggttacaaggaagaagtaataacagattttaatcagcttatatttttagatgcaagggctgaaagtccaaacaccaatgataacagtgtaactattaacggagtagatggtattttaccgggcgcaattagttttgcgccttttttcattagtattaaggtttggctatgatggtatagatgttatagatttaaatttatttgagcattggtttagatctgtgtttaatcgcagacatccttattatgttattacttctcaaatgcctggtgttaaatatgcagtgaatacagctaatgttacatctaatttaaaagatggttcttcaactgaaattgaagtaagtttaaatgtttataaagggtattctgaatcagttaattggaccgatagcgagttcttattcgactctaattggatgtttgaaaatggaattcctcttgatttcacacctaaatatactcatacatcaaatcaatttactatttggaacggttctactgatacgataaatccacgattcaagcacgatttgaaaatattaattaatttaaatgcgagtggaggatttgaactggttaactatacaacaggtgatatttttaagtacaacaaaagtatagataaaaacactgattttgttttagatggtgtgtatgcatatcgagatataaatagagtgggaattgatacaaatagaggcattataacattagcgccaggtaaaaaatgaatttaagattaaaggagacgtcagtgatattaaaactacatttaagtttccttttatttataggtaggtgatttaatggattatcatgatcatttatcagtaatggattttaatgaattgatttgtgaaaatttactagatgtagattatggttcttttaaagaatattatgaactgaatgaagctaggtacatcacctttacagtttatagaactactcataatagttttgtttttgatttattgatttgtgaaaacttcataatttatcatggtgaaaaatatacaattaagcagacagcgccaaaggttgaaggtgataaagtttttattgaagttacggcatatcacataatgtatgaatttcaaaatcactcagtggaatcaaataagcttgatgacgacagtagcgaaactggtaaaacgccagaatactctttagatgagtacttaagatatggatttgcaaatcaaaaaaacttcggtcaaaatgacctataaaataattggagattttaagcgaaaagtaccgattgacgaattaggtaacaaaaacggcttagaatactgtaaagaagcggtagacctgtttggctgtataatttacccaaatgatacagagattggtttttattctcctgaaacattttatcaaagaagcgagaaagtgattcgatatcaatataatactgatactgtatctgcaactgtcagtacattggaattaagaacagctataaaagtttttggaaaaaagtatacagctgaggaaaagaaaaattataatcctattagaacaactgacattaaatattcaaatggttttataaaagaaggtacttatcgtaccgaaacaattgggtctaaagctactattaactttgattgcaagtatggtaatgaaacagttagatttacaataaaaaaagggctctcaaggtggaatatataagttgattttagacggcaagcaaattaagcaaatttcttgttttgctaagtcggttcagtctgaaacaatagatttaataaaaaatattgataaaggcaagcacgttttagaaatgatatttttaggagaagaccccaaaaatagaattgatatatcttcaaataaaaaaagctaagccttgtatgtatgttggaactgaaaaaatcaacagtcttaaatttaattgctgataattcaggtcgcaatcaatacaaagcaattgtcgactacgtcgcagatagtgcaaagcagtttgggattcgatatgctaatacgcaaacaaatgaagatatcgaaacacaggataagctgttagaatttgcaaaaaaagcaaataaatgatactcctaagactgaattagatgttaattatataggttatgaaaaaatagagccaagagatagcgtattttttgttcatgaattaatgggatataacactgaattaaaggttgttaaacttgataggtcacatccatttgtaaacgcaatagatgaagtgtctttcagcaatgaaataaaagatatggtacaaattcaacaagcacttaacagacgagttattgcacaagataatagatataactatcaagcaaatcgtataaatcatttatacactagtactttgaattctcctttcgagacaatggatatagggagtgtattaatataatggcaacagaagaagttaaaatcaaagcgctacttgaaaacgataaacagtactttccagctacacactggaaagctataaatgggataccttatgcaggcagtagtgatattgatggattgcctcaagacggtatcatttcggtagatgataaaaataaattagataaattaaaaataggcgaagcaggaattattcaaaatagcattgtacagaaatccccaaacggtaaattgtggaaaataacagttgacgatagtgggaaacttggtacagtgctattttattagaaaggaaggtgcattatggaaaatttgtatttaataaaggatttgggagctttagcaggtcgagattatagagctaaagaaattcaaaacctgcaaagaatagagcaatttgcgcttggcttgacaacagagtttaagttgcatcagaaagctaaaacaatgcaacacttcgctgagcaaatttattataatggtagatcgcaagcagcagtaaacaaatctttacaaagtcaaattaacgcacttgttgtggcaccacgtaataacagtgctaatgagattgttcaagctcgagttaatgtaaacggcgaaacctttgacacattaaaagaacatttagacgattgggaaaccaaaactcaaattaataaagaggaaactataagagaattaaataagaccaaacaagaaattcttgatatcgagtatcgttttgaacctgataagcaagagtttttatttgtgacagaacttgcacctcttacaaatgcagtaatgcaatccttctggtttgataatagaacaggcatagtatacatgacacaagctagaaataatggctatatgctaagtcgtttaagacctaatggtcaatttatagacagctcattgattgtaggtggggggtcatggtacacataacggttatagatatattgatgatgagttatggatttatagttttatcttaaatggtaataatgagaatacattagttcgtttcaagtatacgcctaatgtggaaattagctatggcaagtatggtatgcaagatgtatttacaggacacccagaaaaaccctacatcacccctgtcataaatgaaaaaagaaaataaaattctatacagaattgagagacctagaagtcagtgggaacttgaaaactcaatgaattatatagagataagaagtttagacgatgttgataaaaatattgataaagttttgcataaaatcagtatccctatgagactaacaaacgaaacccaaccaatgcagggtgtgacttttgatgaaaaatacttgtattggtatacaggagacagtaatccaaataatagaaactatttaacggctttcgatttagaaacaggagaagaagcgtatcaggttaatgctgactatggtggaacactagattcatttcctggcgaatttgcggaagcagaaggtttgcaaatatactatgacaaagatagtggtaaaaaaagctttgatgctaggtgttactgtcggtggtgatggaaatagaacacatcgtattttcatgattgggcaaagaggtattttagaaatacttcactcaagaggcgttccttttatcatgagtgacacaggtggtagagttaaacctttaccaatgaggcctgataaacttaagaatcttgggatgttaacagagccaggtctttactatttatacactgatcatacagttcaaatcgatgatttcccattaccaagagaatggcgtgatgcaggttggttcttggaagttaagccaccacaaactggcggtgatgtaattcagatattgacgcgtaatagttatgcaaggaatatgatgacttttgaaagggtgctttctggaagaactggagacatttcggactggaattatgtgcctaaaaatagtggtaaatgggagagagtaccttcattcatcacaaaaaatgtcagatattaacatagtaggcatgtcgttttatttaactacggatgatacaaaacgttttacagattttccaactgaacgtaaaggggtagctggttggaacttatatgtagaagcttcaaacacaggtggctttgttcataggctagttcgtaatagtgttacagcatctgctgagatactattgaaaaattatgatagtaaaacaagttcagggccatggactttacacgaagggagaattataagttaatgagtaatttagagaaatctgtagctataaatttagaaaacacagcgcattatgaaaatatttcaaatctagatataacttttagaacaggagagagtgattcttctgttcttctttttaatatcattaaaaataatcaaccgttattactgagtgaagaaaatatcaaagcacgaatagcgattcgaggtaaaggagtaa

SEQ ID NO: 5 - DNA, 40763 bp, Unknown
  Description of Unknown: Undetermined Bacteriophage F86/06 polynucleotide
gttttcttctcaaaaaattccctttatctatgtttttttagtaggaggtgctaatttatggcgggtagacctaagaagcttttgtcaaattcgaacaagaattatacaaaagaagaaattattgaaaaagagcgtcaagaagctcaattaaataaattttctaaaatcgatactgaaccaccgcactttttagatgaaatagcgaaacaagaatacttaagaatattaccgcacatgcaagaattgccaatttccaacttagataaagcacaattagcacaatattgtagtttttatagtgactttgttaaagcaagtttgattttagagcgcgaagacttgattttagaagacgacaaaggaaatcaaaaggttaatccggcgttcaacataaaggaaaaagcgggtattcgattgcaacaaacagctaatactttaggattaactattgatagccgattgcgtattatggttcctgatgaaaaagaagatgatgatccatatatggaatttgtgagtgattagtaatgactgattatgttactaaatacgcaaaaaaggtagtttcaggagaaattttggcaagtttgaagaatattcaagtatgtaaacgtcacctatcttttatggagaacccgccgaatggttgccattgggataatcatttgtctaacaaagcaattaaatttgtggaaatgcttccagaccctaaaacaaaccagcccatgcctcttatggagtttcagaaattcattgttgggagcttatacggctggcgtagaggtcaatacagaatgtttactaaagcttatataagtatggctagaaaacaaggtaagtctctaatcgtatcgggaatgtccgttaacgaactgttgtttggacaataccctaaatttaatagacaaatttatgtagcttcatctacttataagcaagcgcaaacaatattcaagatggcaagccaacaagtaaacctaatgcgaagtaaaagcaagtttatccgtgaaaaaacagacgtaagaaagacagacattgaagatgtattaagtagttcagtgtttgcacctctttccaataacccagatgcggttgatggtaaagatcctacagttgctattttggacgaattggcaagtatgcctgatgatgagatgtactcaaggtttaaaacaggtatgacattacaaaaaaatcctttaaccctacttgtttcaacggccggagacaatttaaatagtcaaatgtaccaagagtataagtatattaaacgtattttaaatgaagaagtaagagctgataattattttgtatattgtgctgaaatggattcacaagaagaagttcaagatgaaacaaagtggattaaagcaatgccacttttagaatcaaaagaacatagaaaaactatacttcaaaatgtaaaagctgatatacaagacgaattagaaaaagggacatcgtatcataagattttgattaaaaacttcaatttatggcaagcgcaaagagaagatagcttgctagatatttcagattgggaacaagtaataacgcctatgcctaatatcaatggtaaagatgtgtatataggtgtcgacttatcgagattggatgacttaacatctgtagggtttattttccctaacgacgataaaaaagtgtttttacatagtcattctttcattggattaagaacaaacttagaacaaaaatctaagagagacaaaataaattatgaattagcgattgaacgtggagaagctgagactacacaatcagatagcggcatgattgattataaacaagttatcgattttatagtgaaatttataacgacgcatgacctgaatgtacaggctgtttgctatgacccttggaatgcgcaaagttttataacaacaatcgaatcaatggctttagattggccactcattgaagtgggacaaagttttaaggcgttatcacaatctattaaagaatttagaatgtgggttgcagatgaaagaatacagcataacgataatatgttacttacaacatcagttaataatgccgttttgattcgtgacggagaagacaatgtgaaaataaataaaaaaatgaatcgtcaaaaaatagatccgattatttcgattatcacagctttcactgaagctagaatgcacgaattccaagaaaattggacggagaaatatgaaagcgaagaattcggattttaaaggtggtgacaaaatggacttgaataaaataaatgtcttttttaatttcttggttgctaatttggttagcatcctttttttattaggtttgtttgtggttaatgtttctatgtataaagcattcggtcaaaatataggacttttatgcattggtataacactgattgttatttcgttgattttaaatcatgaaagcaatcaagaaaggagttagtagttgtggggattttttataaaaatgaaaaacgagacttgcaatacaacgaagatgatttgcaaatgatggttcaaactttgccaggttttcaaggaacaaaattacgacaatataaagatatagaagcaattaggcatagcgacatctttactgcagttatgatgattgcttctgatttggcgcgcatgccaattagggtgacagtgaacggccaaattaattatagtgacaggattgttaatttgttaaatacacgtcctaacccaatgtataacggctatatattcaaattagtagtgtttgttagtgccttactaacatcgcacggctatattgaaattacacgtgataaaacaggagaacctatgaatttaacgttcagaaagacatccgaaatagaattgaaatcagacgcaagaggtcgactgtattattttcatcaaaggatagacagtaacggaaataatatagaacgtaatgttaagtttgaggatatgctagacatcaaattttattcgttggatggtataaatggtttgtcactgttagacacattaagtcgcacgatagaatcagataacaatggaaaagatttccttaataatttcttgcgaaatggcacacatgctggtggtattttgaaaatgaaaggtgtattagataataaaaaagcaagagaccgtgccagagaagaatttcacaaaagttttagtggaactaaacaagctgggaaagttgtcgtactcgatgaatcaatgacgtttgatcaattagaagttgatacagaagttttaaagcttatcagagaaaacaaatcatcaacaagagaaatagcaggtgtatttggtattccattgcataagttcggcatagaaacagcgaacatgagtatcacggatgctaatttagattacttatcaactttaaaaccttatattacatgcgtttgtgcagaattgaattttaagtttaatgatgaatatgtgaatcgtgaatttaaatttgataccactgaaatacgagttgttgatgaaaaaacacaagctgaaattgacaaaattaacattgattctggaaagatgaatatcgatgaaattagacaacgtgatggattagcgccaataccaggcggtaatggtagcattcacagagtcgatttaaaccatgtaaatattgaacttgtagatgagtatcagatgaataaatcgagagctactgataaaaaattgaaaggtggtgaggaaaatgagtaaggaaacgagagttggcaacattattgaggtacgctcaaatgataacaacgaaatggtcatagaggggtatgcgttaaagtttgacacttggtctgaaaatcttggtggattcaaagaaacgatttcacgtcgcgctttagaaaacactgatttatctgatgtacgttgtttagtagatcatatcccatcgcaaataattggtaggacaaaatcgggtactttggagctcgaaactgatgatgttggacttaaatatcgttgtaagttaccaaacacaacatttgcacgtgatttatatgagaacatgcgtgtaggcaacatcaatcaatgttcgtttggttttatgcttgacgataaaggcgatgaagtgcgttttgatgaacaagaaaacatttacaaacgtactttaacagcaattcgtgaacttacagatgtttctgtagtgacttatccggcttacaaagacactgatgttaaaccagcattacgtagtattgaaaccgttaaaaaagaacaacgtaaaaaagaattagaaataagactaaagaaacactctatattaaataatatttggtgaagttgaacaccattatcaaatacagccattggacatgctgaatatagcgatgtctatttttttatgccaattttaggaggaaattaaatgaaaacaaaagaagagttacaatctgagatttcagacattaaaagacaaattgatttaaaggtgaagtatgcaacgagagcacttaataacgatgagttagaaaaagcagaaaaattagaacaagaaattactgatttacgttctcaaatccaagaaaaacaagaagaattagataagctaaaagaaaaagatggaacttcagaaaacaatcaacaatcagtggaagtaaacgaagcacgtacttatcgaaaccaagcaaacattaatgatttaggtatttcgattcaaaacacaaaggtaacatcacaagaagttagagattttactgaatatcttgaaacacgcaatgatattcaaggtggttcgttaaaaacagactcaggatttgtagttattccagaggaaattgttacagatattttaaaattaaaagaggttgagtttaatcttgataagtatgtgacggtcaaacgtgttacaaatggttctggtaaatatccggtagtacgacaatcagaagttgcagcccttgaaaaagttgaagaattagaagaaaaccctgaattagcagttaaaccattcttccaattagcatatgacattaatacacaccgtggttacttccgaatttcacgtgaagcaatcgaagatgcaaaagtgaatgttttgcaagaattgaaactatggatggcgcgaactattgcagcaacacgaaacaaagcaattattgatgttatcactaaaggatcaacgggttctacaagttcaggttttgaaaaagaaggtaagaaattagaagttaaaaaagcaaaatctttagatgatattaaagatgctattaacctgaatgttaagccaaattacgaacataatgttgcgattgtttcgcaaactatgtttgcaaaattagacaaaatgaaagataagctaggaaactatttaatccagccagatgttaaagaaaaaacgcaacagcgtttattaggagctaaaatcgaaattttacctgatgaagtactagggcaaaaaggtaataacactttgattatcggtaacttaaaagatgcgattgttttatttgaccgctctcaataccaagcatcatggactgactacatgcatttcggagaatgtttaatgattgctgtacgtcaagactgtagaattctagattataaatcagcaattgtgattgaatatgatgatagtgaacgcggtgaaggcgatcttggcttagaagcataataagcgctcgatactttataaagaggtgataaactatggcaatgtatgaagtgaagaaatcttatactgacttggaaaaaggccagtatttaaagtcaggtaaacgtgttgaaatgacagtaaaacgtgctgaatatgttaacaaaaagctgaaagagcatggagtaatacttgaaagagtaaaagaagaataggtgattgaatgcaattaacagctgaggaacttaagttattaaaaaagcattgcaaaatagatcacaattcagaggacgacttattagaaatatattactcttgggcattccatgaaatagctagcgctgttacggatgaaccaagtaaatatattgattggtttaaaagtcatcctctatttgctcgtgctatataccctttagcaagttactattttgaaaaccgtattgcttatttggatagggatttatcgcttgcgccacatatggttttaagtacggtgcataaattgagaggttcatttgagcaatttttggagagtgaaaatgatgaaatttaattccaataaattaaatgaacgtatagatttttgtgaagatgtaagcgagagagtgaacggaaatccgatgaaaccgaagacgaaaatattatactcttgtttcgcttgcattcaagaatctaaagaatccgacactcaaacgaatctcaatacaggtagcaaattcattaaaactattattatcagagatacacgaggtgattataaaccaacaaataagcattacgtcttgcatgaagggcaaagatttaacatcaaatatgtaaagccagattatcaagataaatcttatttgcgtatctatggcgaggtggtcatttaatgggggcaagaattgaaagtaataacattgaacaaggtttgaaaaatgcagttttaaaaatgaatttaaatagtaatgtaattgtcaaagctggggctatgtcattagtcccgcttttaaaaagcaatacgccttttgcagatactaaaaaacacgctcgtgatcacatagctgtttctaatgtgaaaacagacagagacacaagtgagaaaatcgttacaattggttacgctaaaggcgtctcacaccgtattcatgcaacagaatttggaacaatgtaccaaaaaccacaattgtttataacaaaaacagaaaagcaagggaaaaacaaagttttaaaaacaatgcttgatactgctaagaggttgcaaaaatgattaatgttaccaaaataattagaaacgctattattgcaaataacattacagatgaagtgaatgtgtttaactacactatagatgaccattttcacgaaaaaactgacaagcctattattcgtatatatcccttaccgttcaatcctgacacatacgctgatgataacgagatttcaagagaataccattaccaaattgatgtttggtggtctcaagatgaaccgaacgagcaagcagaaaaaattgttgagttactcaaagtgataaattttcaatgttattacagagaaccgttatacgagagtgacgtcatgtcattcagacatattataagagcaaaaggctcgattttatcaatgaaattggaggaaaattaaatgattgaaaaattgaaacaagcaccaagatttttaaaattaaacttacaacattttgcagatacaggagtttcgggtatcgcaattggggtatcaaacttttattatgcacctattttaaaagatacagaaaatgaatgggaaactggagctggcacacgtattcgtttcttaaaagaaattgaagtagaccgtccacaagataccgaggaagattatggagatgatatggtcgcagcaactgctgtatctaatggtaaactgagtgttaagacaacatttgttactgttcctgctgacgataaggcgttcttgaatggcgctaaaaaaggtgtaggtggttataaatatggagctaaggatattccgccagatgtagcgattgtatttgaaagacgtaatcatgatgagtcttcagaatgggttggcttgttcaaaggtaaattcactcgttcaagcatcaaagggcaaacgaaacaagataaggttgaattccaaaatgatgatgtagaaggtaactttattgatcgtttatttgatgaaagctcgcatgttacaggctatgataaaaaaggaagcactacagggcgcgattatgtattcatggaaacatttggtaaaacttatgatgaattcatgtctagtcgaggagaacaaaatatggaacctgtagaaaaagaaatgaaaaaaacagaaaaagttgaagtcacttctgtaaacgtcactgatgaacaagttacagttaaagttgatgctactaaacaactatcagccacaaccgaaccatctggacagaaagtaacttatgcagtgactgaggggcaaacgtatgctagcgtaacatcaactggtctcgttaaaggtttggcggaaggtaatgcgaccgttacagcgactgcaggaaagcaaactgatactgtgcaaattacagtacaatctaatttagaaatgtaagttttgagggcttaacgccctctttttattttggccaaattaaaaagaaagtaggaatttaataatggaacgtacatcaattgaattaattacaggatttacaaaaacaggaaagccgcaatatcaaaagtatttagcaaagccgattattactttgtttgaaacaattcaaggttcaaaattaggtttgaaacttaacaaagcctttaagggggctgattttaaagatctaacagaagaagaatttaataacttaagtgtgacagaacaggaagaatacaaaaacaagcaagaagaatacgaaaacaacatggctgtacaaatggaagtattggaagaagttttggatttcatcgttgaagcttttgataatcaatttactagtatagaacttcaaaaaggattaccaaatggtcaagaaggtattgaaaagattggacagttaattggacgcattacaggtggggaacctagcgatacaaaaaagttcgtgacagagaatcagaaataagaaaagaagatttaacacctgaagctgtctacaacaattacaggaaaatagctaaagatttgatagaaaacggcatggatgcagaaaaagtggctaacatgccgatacacttctttttagacattgtcgaatcgaagattgaaacaaagcgaactgcgaaaagttttaaagatattttttaatcagcctttaaaggttgattttttatttacatcttggaagaaaggaggtttttaaatgcctaatcctataggtaatatggtcataaaggttgatttagatggttctggattcaatagaggtgtgacaggtttaaataggcaaatgaaaatggtttcgcgtgagctttcggctaatttatcacaattttctagatatgataattcattagaaaagtcgaagataaaagtcgaaggtttgagtaaaaaacaaaaagttcaagcccagattactaaagagctgaaagatagttatgacaaacttagtaaagaaactggtgaaaacagtgcaaagacacaagctgcggctgctaaatacaatgaagcttacgctaaattaaaccaatatgagcgagagttaaaccaagccacacaagaattaaaagacatgcaaagagagcagaaagcattaaatactgcaatgggaaaacttggtaccaactttaataattttggtcctaaacttcaagaaattggtaacagtatgaaaaatgtaggccgtaacatgactatgtatgtaactgcgccggtggttgctgggtttgctgtagcagctaaaaaaggtattgaattcgatgacagtatgagaaaagttaaagcaacttcaggtgctactggtgaagagtttgaagctttgaagaaaaaggctcgcgaaatgggtgcaacaacaaaatttagcgcatcagattcggctgaagcattaaattacatggcacttgctggttgggattctaagcaaatgatggaaggtttaagcggagttatggatttagcggcagcatctggcgaagaactgggagcagtaagtgacattgttacagatggactaacggcatttggtttaaaagcaaaggatagtggtcattttgcggacgttttagcacaaactagctcgaaggcaaatacggatgttagagggctcggagaagcttttaaatatgtcgctcctgtagcaggtgcgttaggttacacgattgaagatacatctattgcgataggtttaatgagtaatgctggtatcaaaggtgaaaaagcaggtacagcgttacgaacaatgttcaccaatctttcaagtccgactagagctatggggaatgaaatggagcgcttaggaatatctattacagatagtaatgggaaaatgattcctatgcgaaagcttttagaccaactgagagaaaaatttaaacatctttcaaaagaccaacaagctagttctgcagctacaatatttggtaaagaagcgatgtcaggagcattagcaattataaatgcttctgatgaagactatcaaaagttaaccaaatctatagattcatctaccggcgcatctaaaagaatggccgatacaatggaatctggtttaggtgggaaattaagaactttaaggtcgcaattagaagaactagccttaacgatttatgacagaatagaaccagcactaaagattatagtaagtgcttttagcaaagtagtgacatgggttactaaattaccaacgtcaattcaattagcggttgttgggtttggattatttgcagcagttttaggtcctttagtttttatgttcggtttatttatcagcgtgatggggaatgcaatgacagttttaggacccttgttaataaacgttaataaagctggtggtatattcgcgtttttaagaactaaaatcgcatcacttgttaaactatttccgattttaggtgtgtcgatatccagtttaacgttacctataacattaattgtaggtgcattagttggtattggcatagctttctatcaagcttataaacgttcagaaacttttagaaatattgtaaatcaggcaatctctggtgtagcaaacgcatttaaagcagctaaactagcgttacaaggtttctttgatttattcaaaggtgatagtaaaggcgcggttaccctagagaagatatttccacccgaaactgtagcaggaatacaaaatgtagttaatacgattagaacaactttctttaaagtagttgatgcaatcgttggtttcgccaaagagataggcgctcaattagcctctttctggaaagagaacggctcagaaataacacaagctttgcaaaatatagctggtttcattaaagcaacctttgaatttatttttaactttattattaaaccaatcatgtttgcgatttggcaagtgatgcaatttatttggccggcggttaaagccttgattgtcagtacttgggagaatataaaaggagtaatacaaggtgctttaaatataatacttggctttattaagttcttttcaagtttattcactggtaattggcgaggtgtttgggacggtattgtaatgatactgaaaggtactgtgcagttaatttggaatttaatacaactgtggtttgtaggtaaaattctaggtgtagtgagatactttggtggattacttaaaggtttaatatccggtatctggagtgttatcaaaggtattttcacaaaatctttatcggcaatttggaatgcgacgaaaagtatttttggtttcttatacaatagtgttaaatctattttcactaatatgaaaaactggttatctagtacgtggaataatatcaaaagcaataccgtcggcaaggctcattcgttatttacgggtgtaaggtctaaattcacaagtttatggaatgcgacgaaagatatatttactaaattaagaaattggatgtcaaacacctggaactctattaaagacaatacagtaggtatagctggtcgtttgtgggataaagtacgtaatatattcggaaacatgcgtgacggtttaaaatctatcattggtaaaattaaagatcatatcggtggtatggtagatgctattaaaaaaggacttaataaattaattgaaggcttaaactgggtcggtggtaagttaggtatggatgaaatacctaggttacacactggtacagagcacacacatactactacaagattagttaagaacggtaagattacacgtgacacattcgctacagttggggataagggacgcggaaatggtccaaatggttttagaaatgaaatgattgaattccctaatggtaaacgtgtaatcacaccaaatacagatactacggcgtatttacctaaaggttcaaaagtatataacggcgcacaaacttattcaatgttaaatggaacgcttccaagatttagcataggtactatgtggaaagatattaaatccggtgcatcatcggcatttaactggacaaaagatcaaataggtaaaggtacaaagtggcttggcgataaagttggtgatgtcatggactttatcgataatccaggcaaacttttaaattatgtacttcaagcgtttggagttgatttcagttctctaactaaaggtatgggtattgctggcgatataacaaaagctgcatggtctaagattaagaaaagtgcaatcaagtggcttgaggatgctttcgcagagtcgggtgatggcggtgtattagatatgaataaattacgttacttatacggtcacactgctgcttatacacgagaaaccggacgcccattccatgaaggtctggattttgattacatttacgaacctgttccatcaaccattaatggtagagcacaagttatgccttttcataatggtggttatggaaaatgggtgaaaattgtaaagggcgccttagaagttatttatgcacatttatctaaatataaagttaaaactggtcaacaagttagggtcggccagactgttggtatatcggggaatacggggtttagtacaggacctcacttacattatgagatgcgttggaatggaagacatagagacccgttaccgtggttaagaaagaataatgggggcggcaaaagtacacccggtggtaatggtgcagctaatgctagacgagctattaaggctgctcaaaatattttaggaggaaggtataaggcgagttggattactaacgagatgatgcgtgttgcgagtcgtgaatccaattatacagctaatgcagtcaataattgggatagcaacgcaagagctggtataccttcaagaggtatgttccaaatgatagatccttcatttagagcgtacgcaaagtcgggttacaataatcctctcaacccaactcatcaagctatatcggctatgagatatattgtgggtaaatgggtaccaagaacaggctcatggagagctgcgttcaaacgcgctggtgattacgcatatgctactggtggcaaagtctataacggattgtaccacttaggggaagaaggatatccagagtggataatacctactgatccaagtagagcgaacgaagcacacaaattattagctttagctgctaacgatattgataaccgctctaaaaataagcgaccaaacaacttaccaaatccaagtataagtaatagtgatacaaactatattcatacattggagaataaactggatgcggttattaattgtttggttagtttggttgagtctaatcaagttattgcagataaggattacgaaccagttattaataagtatgtgtttgaagatgaggtaaataattctatcgataaacgagagcgtcacgaatctacaagagttagatttagaagaggaggcacgataatctaatgcaagatacaattcaaatagacaataaaaccattgaatggttagttgtacaaagagggtttgagataccctcttttaattttgttactgaaaaagaaagtgtgaaaggtagaacaggttctattgctaaagctcgttatctaaatgatatcgaatttgaattacctctaataattagaaatgaagtcttggcgccaggtggacaaaaaacgcatgacgatatattggaagagttagttgaattttttgatattgacaatttaaagccgaaaaaacttaaattcaaatctcaaaactggtattggtttgcatactttgatggaccattaaaattaccgaaaaacccaagaggttcagtgaagttcactatcaaagtagtactaacagacccttacaaatattcagtaacaggaaataaaaatactgcgatttcagaccaagtttcagttgtaaatagtgggactgctgacactcctttaattgttgaagcccgagcaattaaaccatctagttactttatgatcactaaaaatgatgaagattattttatggttggtgatgatgaggtaaccaaagaagttaaggattacatgcctcctgtttatcatagtgagtttcgtgatttcaaaggttggactaagatgattactgaagatattccaagtaatgatttaggtggtaaggtcggcggtgactttgtgatatccaatcttggcgaaggatataaagcaactaattttcctgatgcaaaaggttgggttggtgctggcacgaaacgagggctccctaaagcgatgacagattttcaaattacctataaatgtattgttgaacaaaaaggtaaaggtgccggaagaacagcacaacatatttatgatagtgatggtaagttacttgcttctattggttatgaaaataaatatcatgatagaaaaataggacatattgttgttacgttgtataaccaaaaaggagaccccaaaaagatatacgactatcagaataaaccgataatgtataacttggacagaatcgttgtttatatgcggctcagaagagtaggtaataaattttctattaaaacttggaaatttgatcacattaaagacccagatagacgtaaacctattgatatggatgagaaagagtggatagatggcggtaagttttatcagcgtccagcttctatcatagctatctatagtgcgaagtataacggttataagtggatggagatgaatggattaggttcattcaatacggagattctaccgaaaccgaaaggcgcaagggatgtcattatacaaaaaggtgatttagtgaaaatagatatgcaagcaaaaagtgttgtcatcaatgaggaaccaatgttgagcgagaaatcgtttggaagtaattatttcaatgttgattctgggtacagtgaattaatcatacaacctgaaaacgtctttgatacgacggttaaatggcaagatagatatttatagaaaggagatgagagtgtgatacatgttttagattttaacgacaagattatagatttcctttctactgatgacccttccttagttagagcgattcataaacgtaatgttaatgacaattcagaaatgcttgaactgctcatatcatcagaaagagctgaaaagttccgtgaacgacatcgtgttattataagggattcaaacaaacaatggcgtgaatttattattaactgggttcaagatacgatggacggctacacagagatagaatgtatagcgtcttatcttgctgatataacaacagctaaaccgtatgcaccaggcaaatttgagaaaaagataacttcagaagcattgaaagatgtgttgagtgatacaggttgggaagtttctgaacaaaccgaatacgatggcttacgtactacgtcatggacttcttatcaaactagatatgaagttttaaagcaattatgtacaacctataaaatggtattggatttttatatagagcttagttctaataccgtcaaaggtagatatgtggtactcaaaaagaaaaacagcttattcaaaggtaaagaaattgagtatggtaaagatttggttgggttaactaggaagattgatatgtcagaaatcaaaacagcattaattgctgtgggacccgaaaacgacaaaggaaagcgtttagagttagttgtgacagatgacgaagcacaaagtcaattcaacttacctacccgttatatttggggaatatacgaacctcaatcagatgatcaaaatatgaatgaaacacggttgcgttctttagccaaaacagagttaaataaacgtaagtcggcagttatgtcatatgagattacttctactgatttggaagttacgtatccgcacgagattatatcaattggtgatacagtcagagtaaaacatagagattttaacccgccattgtatgtagaggcagaagttattgccgaagaatataacataatttcagaaaatagcacatatacattcggtcaacctaaagagttcaaagaatcagaattacgagaagagtttaacaagcgattgaacataatacatcaaaagttaaacgataatattagcaatatcaacactatagtaaaagatgttgtagatagtgaattagaatactttgaacgcaaaatacacaaaagtgatacaccgccagaaaatccagtcaatgatatgctttggtatgatacaagtaaccctgatgttgctgtcttgcgtagatattggaatggtcgatggattgaagaaacaccaaatgatgttgaaaaattaggtggtataacaagagagaaagcgctattcagtgaattaaacaatatatttattaatttatctatacaacacgctagtcttttgtcagaagctacagaattactgaatagcgagtacttagtagataatgatttgaaagcggacttacaagcaagtttagacgctgtgattgatgtttataatcaaattaaaaataatttagaatctatgacacccgaaactgcaacgattggtcggttggtagatacaaaaactttatttcttgagtatagaaagaaattacaagatgtttatacagatgtagaagatgtcaaaatcgccatttcagatagatttaaattattacagtcacaatacactgatgaaaaatataaagaagcgttggaaataatagcaacaaaatttggtttaacggtgaatgaagatttgcagttagtcggagaacctaatgttgttaaatcagctattgaagcagctagagaatccacaaaagaacaattacgtgactatgtaaaaacatcggactataaaacagacaaagacggtattgttgaacgtttagatactgctgaagctgagagaacgactttaaaaggtgaaatcaaagataaagttacgttaaacgaatatcgaaacggattggaagaacaaaaacaatatactgatgaccagttaagtgatttgtccaataatcctgagattaaagcaagtattgaacaagcaaatcaagaagcgcaagaagctttaaaatcatacattgatgctcaagatgatcttaaagagaaggaatcgcaagcgtatgctgatggtaaaatttcggaagaagagcaacgcgctatacaagatgctcaagctaaacttgaagaggcaaaacaaaacgcagaactaaaggctagaaacgctgaaaagaaagctaatgcttatacagacaacaaggtcaaagaaagcacagatgcacagaggaaaacattgactcgctatggttctcaaattatacaaaatggtaaggaaatcaaattaagaactacaaaagaagagtttaatgcttctaaaagaacactatcaagagtgttagcagacatcactgtaaatgctatgaaaggcatctatttaaggtatgacgaaaatggggcgattacttcacatactattgataaagatggcgtgaaaattagtggcgataaagttgatataacagcgaatagagaatttaatgtagtcgcaaataatattaataacaaagttggtaaaaatgacattgttaatagcctaaacttatcaaatgaaggtcttgacatcaatgtgaatagaattggtattaaaggcggaaatgctaaccgttatgtacaagttcaaaatgattttattgaacttggcggaatcgtacaacgaacttggaaaggcaaacgatcaaccgatgatatattcacacgtcttaaagatggacatctaaggtttagaaataataccgcaggcggttcactttatatgtcacattttggtatttcaacatatattgatggagaaggcgaagacggaggttcatccggtactattcaatggtgggataaaacttacagtgatagcggtatgaatggcataacaatcaattcttatggcggtgtagtcgctttaacatctgactacaaccgaattattatcgattcatatgcttcagctaatattgaaagtagagaagcaccgatatatttatctccgaacaccaaaaataaacctggtttaaaccgattcgcattcacattatcaaacgctgatagtgcatacgaaactgacggttatatcatgtttggttcagatgaaaactataagtacggtgctggattaagattttctaaacgtagcaataaaggattggttcaagtcgttaatggtgactatgctacaggcggagacactacaattgagtcaggtatgggcaaattcaacatagttaaacgaagagatggaaatagttacgttagcattcaaagttatgatttattggcggtaggttctgataatgctggcgatagagtcgcttctaattctatttataagcgtacttattcagcacctgctaacttacacattacttctgctggaacaattgggcgtgctacttctgccaaaaagtataaaatttcaatcgaaaatcaatacatcaatgaagacgatcagttcagtcattcaaaagagattttaaagcttccaattcgtacatggtttgacaaatatgaatcggaaataatggctaaagaattggaaagtggtaaaaagttatctgatgatacttttaaacttagtcgacatactggcttaatagcggaagaggttgaagaattaggatttaatgaatttgttatttatgatgacaacggagaaatcgaaggtatcgcatacgatagactttgggttcatttaatacctattattaaaaaccagcaatcaaaaatcgaaaaactggaggaattaataaatgaatgatagcaatcaaggtttacaagccaatccacaatatacaattcactatttatcgcaagaaatcacaagactaacacaagaaaatgcaatgttaaaagcatatatacaagaacaaaatgaaaaaagcaaaagtgctgaggaagagtaatccttggcactatttttatacaaaaatttaaggaggtcatttaatatggcaaatgaaattatcaaaaaaacagagagatttattttagtacaaattgacaaagagggaacagagcgcgttttgtatcaagattttgtaggcagttttacaacgtccgattcagcaagttatgcacaagattttaaatctgaggaaaacgctaaaaagattgctgaaactttaaatcttttatatcaattaacagtcaatcaaaacggtgtgaaagttgtgaaagaagttgtggatagaactgacttgtcatctgataaatcagttgatagcgaaataatgtaactatactaagttatgagcattacgctcatagctttcttagaaagtaggtgtagttttggatgatattcagaaaataaaaaaagagctttctgaattagttgaacgtgttgatgatgttgaaatactagcaaacgaaacagctgatcatgtgcttgaacttagagaggaacataagcaacatcataatgaactaagagaatctcataaagaacttaaagataagcaagataaagttgtagatgagaatttagagcaaacaaagatattaaacagaattgaagaaagatatcaaacgcaagtagatgttgcgcaaaaaaatgaagaaaagacactcgcccaaaataaatggctcgtaggtgccatatgggcgcttgtaacaattgttatgattgcagtcattactgcatcaattactgcgttattaccttaagggaggtggacataatgagttgggcaagatggttatcatgttatttgtatggtcgtaaatgtaaataatgtttttggtcagtgcatcggcactggctttttatttattgttgtaattatggtaatatgcagaagtgagcaagttggatagatggtggctatctgagtataaggaggtggtgcctatgttggcattactgaaatctttagaaaggagatgcctaatgattacaattagtaccatgttgcagtttggtttattccttattgcattgataggtctagtaatcaagcttattgaattaagcaataaaaaataaccatcgctaactttggctggtttcgatggttaaatggttattaatttaatctttaatctaaaatagccaccgtctttttaacgggctcattagggtaacatgtttgcgcatgttgccctttttctatatataaattaacacaccataatataaatatcaaatagacggcttattagtcgtctttttattttgggtaaaaggagataagaatatgattaattggaaaattagaatgaaacaaaaatcattttgggtagcgatattgtcagctatctttttatttgctcaaaacatcgcaaaagctattgggtatgatatccaagtttatacagagcaattaacagacggtttaaacgctatattaggatttttagtattaactggtgtgattcaagacccgactactaaaggtataggtgatagccaccaagctttagaatatgaagaaccaagaagaaaatactaggaggtaaaataatgaaaacatacagtgaagcaagagcaaggttacgttggtatcaaggtagatatattgattttgacggttggtatggttaccaatgtgcagatttagcagttgattacatttattggttgttagaaattagaatgtggggaaatgcaaaagatgcaatcaataacgattttaaaaacatggcaacagtatatgaaaacacaccatcgtttgttccacaaataggtgatgtggctgtatttaccaaaggaatatataaacaatacggtcatattggtttagtgtttaatggtggtaatacaaaccaatttttaattttggaacagaactatgacggtaacgcaaatacgcctgcaaagttacgttgggataattattacggctgtactcactttattagacctaagtataaaagtgagggcttaatgaataagatcacaaataaagttaaaccacctgctcaaaaagcagtcggtaaatctgcaagtaaaataacagttggaagtaaagcgccttataaccttaaatggtcaaaaggtgcttattttaatgcgaaaatcgacggcttaggtgctacttcagccactagatacggtgataatcgtactaactatagattcgatgttggacaggctgtatacgcgcctggaacattaatatatgtgtttgaaattatagatggttggtgtcgcatttattggaacaatcataatgagtggatatggcatgagagattgattgtgaaagaagtgttttcattcttaggttaaaatgttaaatatttgttaattattttttaatgtaagtttagtttcttttaatattttattgatttttaatattttctcaatataaaatgaagttgttgatatttatcatcttaaataagggtgttagctataaaaagagataaataaaaacaaatatattatatttggaggaagcgccatgctcaaaagaagtttattatttttaactgttttattgttattattctcattttcttcaattactaatgaggtaagtgcatcaagttcattcgacaaaggaaaatataaaaaaggcgatgacgcgagttattttgaaccaacaggcccgtatttgatggtaaatgtgactggagttgatggtaaaggaaatgaattgctatcccctcgttatgtcgagtttcctattaaacctgggactacacttacaaaagaaaaaattgaatactatgtcgaatgggcattagatgcgacagcatataaagagtttagagtagttgaattagatccaagcgcaaagatcgaagtcacttattatgataagaataagaaaaaagaagaaacgaagtctttccctataacagaaaaaggttttgttgtcccagatttatcagagcatattaaaaaccctggattcaacttaattacaaaggttgttatagaaaagaaataaaacaaaatagttgtttattatagaaagcaatgtcttgcttgaatatgtgtagtgaaaattatctttcatcaaattctcattcatgcacgaatggctcttccccacctaatcagatattaggtgacttatggggagaaatcagttaggatgaaaaagtggataatcctttttttaggcaggtacttcggtacttgcctatttttttatgttataatctttctagacgtattcaaaggacgtctttttagattgtatgttatagctagctttcgggctagttttttgttatgatgcgttacacatgcatcaactatttacatctatccttgttcacccaagcatgtcactgggtgtttttttcttatgatagagagcatagttttcatactactccctcgtagtatatatgactttagcattcccatataatagtttacggggtgctttttatgttataattaactgtatatagtaggagtgaactatatagcctgttaagtggcctagtaacctaacacttatcctgcaattgatatcctttttgcccttcactcgatacatatatctcaacaacatagaaatattacagtcgctacaccgcatcttaaatggtgtggttatttttattggaagtgtgtatcaggtatcagtaatgttaaaacaccagctaaaaatgaaaagaattcaccagtgccagcaggttatacactcgataaaaacaatgtaccgtataaaaagagactggttattacacagttgccaatgttaaaagtaataacgtgagggatggctattcaactaattcaagaattacaggtgtattacccaataacgcaacgatcaaatatgacggcgcatattgcatcaatggctatagatggattacttatattgctaatagtggacaacgtcgttatatagcgacaggagaggtagacaaggcaggtaatagaataagcagttttggtaattttagcgcagtttgaaaaaaaagtgtgtaaagtttcatatgaagttaattaatttattatagaatagtttaaaattatgctataatcattttagacacagcaatgtgttcaaattttcatctattcataagctagccttcgggctagtttttttttgctatatatttgttttaattaaataaaattagataatgcaatagtagccattttatgttaatattaccttgggcgttttcaaggagcgcctttcattttttatgtattgctccccttcgggctagtatattaaatttatttttgcgctttccaaatcaatgtatatgtgttatattgtttatgggaagtaggtaagcatttcggtgcttacctttttttgtttttctataaatacaataaggtatgtcaatttgataatttattaattttcatttaataagaagatctatatagttaatgaataattaatgtacttttttttagttagtcattaaaataaattagtactaattactaaggagaataaaaaatgaaaattagaaaatctatacttgcgggaactttagcaatcgttttagcatcaccactagtaactaatctagataaaaatgaggcacaagctagcacaagcttgccaacatcgaatgaatatcaaaacgaaaagttagctaatgaattaaaatcgttattagatgaactaaatgttaatgaattagctactggaagtttaaacacttattataagcgaactataaaaatttcaggtctaaaagcaaatatttggtttctaattatttttgttttaacagtgcttgtatttaatcctttaattgttaaattcattatctggttaattaatgaaacaagaaagtttatgaatttggattgtataagcttattagacaaaagagacaagttgtttaataacaacggtaaaccagtatttatagttattaaagactttgaaaacagaatcattgaagagggtgaacttaaaacctataattcagctggtagcgatttcgatttactagaggttgagcgacaagatttcaaagtatctgatttaccgtcaaacgatgaattgtatattaaacatacacttgtagaccttaaacaacaaattaaattggatttatatttaatgaatgaatattaatcttttttcttagctttttctgataaagtgctttttaagttttcgctggcacccggcttttcaaaacttttgtttattgggttactacgagtagcttcttgttttttgtttttatccgccataaaattctcaccaccattcaacgtctacacttgtaggcgttttttgattagtaaaatcataatgaatcttctttggttaacttatcgccatctattttttgtgaaataaattccaagtatttacgcgcattatgtgacgataaatctttaggtaactcataagtgaatggttgattaccactagttaaaacttcatatactatagtttctctttttattttgcaattagttattttcattataaacttcctttcaaacactgctgaaatagacgtcttttttaaataagcataattaatacttcaattctttaatccacatatatttaaaagtgagatagtaggtaataaatataagacttaaagttaagattgcttttttcatgtttcataattaaaacctctgtaaatttaaggttagtattatgaaataatggattggtttattctttagtactaacttcgtagtaaattatatagttcgctaaattgtatttatctactatatttttggaataaacaatttccttttctttcttcagtaaattataaaaatctacatcattttcgttagctgattctattttggtgatatcagattgtctaacgattcttttagatctgtcaaggtatataaatttccctgatttagaattagtctttttattcacaccgacgtaaattgaaagtaatatactttttccaaaaacagcatcactgtgattatggttttcatcttctataactaagaatacatgtttttttgtaaaaatttttttgatcatcgttattattcctttattaaatttattaagtcttcttcatttaaaaattgaatttttgcaccatttccaacatattctcgagcttttcgttgttttgaaactagtccgttcacatctttatatttatcatcttgaacaccttcgactaaaatatctgtttttgcagttacgtcacttctgatataagctcctttctttctagttaatatcattaaatcttgtttttcagtgtcaaaattacctgtaaaaacaacatttttatcttttaaaatagggattacactttccacttctattttattaatctcagatattttcatatgaattttttgaaatcctgaatcgaaaagtttagttggagagttagaatatttgctaaatctaatgtattgcttaggcatataatgtattaattttaatacactataatgctgattgtttttagcgagtgatatcaacatcttcgataaagctagcacgtcaaatttagcagaatgtaatttttctttatcgatatcatataagctacacaaattttctaatttaaaactagagattgcgtggaagcttctaaagatatttatactatcgacatacatgaagtttggaacaggtaagtcataataattattagtattttttaatactgaaatatcaaaaagtgcattatgagcaataattaaatgtgattcttttaaaagatagagaatttcttggtaaatatctggatatttaggtgcttttaatatgacatcttcaggtattttatgtattttagcgtttttcaagttatatctattattaggaggattaatataagatgaataaacttttactattgataaatccttaattaaagatacagcaacttcgcaagggctgttcatatgttcattcatagtttcaaagtctaagactgcaatatcatattttttcatttgcaagtgctccttttataaaataacttttccaattaacctcacactttcatttctataaaagtgtagatcgtcgtaatctttatttagtgaaactagagtcaatctatcatcttcaacaaagactttcttaacgtacgcttcttcttcaatgatgaatataccaatttgtccattctttatattgtgagttttctccacaaatatgatttcgccatctttaaacataggttccatagaatcaccatttacttttaacgctaaatcgtgtgtggggataggtcctttaaccatttcagtaaatagcgtttcatcgtgtaaacgttctcctacaccagcagagacgcaaccattgacgttaactggagttttctcctgtttatatgaattaatatctacaacgttatctcctttagaattctgttcttccaattgttcatttgcatagttaagtacgttttcttggcggggaggtgtgagtttgttgtatatggaagtgatgtcgttatcgtctttgtatgtagtatctatgtcgcttttaccaacctcgaaaacatcagctatcctttgtataacgccgtgagaggggttggaacgtaaatttaaataatcgcttaaagtagatggttttatgttaatgagttcagcaagtttcttttgagacatatttgaatcgttgagaaattttctaatgtttttggctataataatatttctttctttgttcatattacttacctccttttttcttattatacgaaattttcatatcatagtaaagttttttacgaaaaaaacgtatttaatgttgacaatacgaaaatttcgtattatattaggtttacgaaaggcggtgacaacatgaaaacattaaaagagttgaggactgattacggattgactcaaaaagagttaggagatttatttaaggtctcatcacgtacaattcaaaatatggaaaaagactctacaaacattaaagatagtttactttctaagtatatgagtgcttttaatgttaaatatgatgatatttttttaggtaatgaatacgaaaatttcgtatttacgaatgataaaaagaaatcaattattttagcatttaaagaaaaacaaacatcttaataggaggaataacaaatgaacattcaagtagcaacgaagctagcgatggagaaaggaataagtataaggagagagaatcaagatgtgtatgggatattaccaactaatttgcagcgttatcaatgcctagtcgtgtctagacactataagaaaaaaagacaaaccgccgccggaaggtggcagcctagcgcagacgatttaatagcagatgattggattttagattattaattttttcaaatctctaattaaacccataagtgttttgtaatcttttttggattctgattctgagtaggcgataccttctcgagaaagagccatctcaagaaaaccgccatcttcagcagaagcaattacaaaatctctatgctttaattcaagaactgcatcgatatagtcttcaaaattaaaacctaaaaagaaagcgttaaatgaggattcatcactaccgaaataagatgcagaacgtttagacataccttcgtcaattctatcaaggtaaattgaataaagttgtaaaaggacaaatttagcttcatcagtcataagtcattcacctccttaataggagtatagcagaaaggagcacaaacaatatgcaagcattacaaacaaaatcgaacataggcgaaatgttcaacatacaagaaaaagaaaatggagaaatcgcaatcagcggtcgagaacttcatcaagcattagaggttaagactccatacaaaaaatggtttgaaagaatgagtgattacggatttgaagaaaatatcgattatatagtcacggacatttttgtccataacccactaggaggtcgtcagaatcaaactgaccacgcactcacactagacactgcaaaagagattgcaatgattcaacgtagtgaacctggcaaacgtgcaagacaatacttcatccaagttgaaaaagcatggaatagcccagaaatgattatgcaacgtgctttaaaaattgctaacaacacaatcaatcaattagaaacaaagattgaacgtgataaaccaaaaattgtatttgcagatgcagtagctactactaagacatcaattttagttggagagttagcaaagatcattaaacaaaacggtataaacatcgggcaacgcagattgtttgagtggttacgtcaaaacggattccttattaaacgcaagggtgtggattataacatgcctacacagtattcaatggaacgtgagttattcgaaattaaagaaacatcaatcacacattcggacggtcacacatcaattagtaagacgccaaaagtaacaggcaaaggacaacaatactttgttaataagtttttaggagaaaaacaaacatcttaataggaggaacgaacaatgcaagctcaaaacaaaaaagtcatttattactactatgacgaagccggtaatagacgacccgttaatattcaatacaacgatggctacgacttaatgatagacccgcgttttattgaaatgacgcttgaaagacatccgcatttaaaaaataacttttatggattaatagatggaaaagaatttaagttagattaaatttttggaaatgcaaaggaggcataacaaatgttacaaaaatttagaatcgcgaaagaaaaaaataaattaaaactcaaattactaaagcatgctagttactgtttagaaagaagtaacaaccctgaattgttgcgagcagttgcagagttgttaaagaaggttaactaaattaggccttattattactttttagaatgtgaacaataggtcgataaaaaacttaataaacaaactatagcaactatcaatgaattttgaatatgtaaatcgttctcgtttatatagtttgttacaaagatttgaatgtcagcacctgctgcaatgccattagaccatcttattaactttttgaaaggatgtggaaaatcattttcgatacgtttgacaaattcatcgtgtctcttgtaggtactttgctcatttattggataggtcgaattgatggcttcagccaaagtagagatagcagttggattgatataaaaatctctaatggtctgttgtgcttgaagtacaatctcatcatcaaacctatagagttccttaaaagattttatcgtttcttcagaaaataaatttctttgaaatgttagagatgaaaaagaattacgcaaattaaaattcatttcaattaagttgtttagatgaaagtctactttgaagtcagaaaataaatttatgttgtttctattaattatatctaattggtacttaggttttaaagattgtttaattgccatacttttagaaatttcaacattactaattacgttattaatagaaaaacgaacattttttaaaggatcaatatacaccaatatcacctcctttcactaggagataacaacattatacacgaaaggaaagatagaaatgccacatattttaaacgtaacagttccaatacctgaaacacatgtacttatcacaaaagatgaatatgatgagctaattggttattcattagaccctgtatggaacatgagtgacttaaagaagaaattaaaaattgcatctgatgagactatcaaggacagattactatttcatcctagatttgaaaaagaactaagagcgcaaggaattgtgcattacccagatgagaattttaatcgctggagatttaacgcaagaaagatgaataaattcgtcgatgagcatttcaatgaaatatataaggagagaataaaatgagcaacatttataaaagctacctattagcagtactgtgcttcacagtcttagcgattgtgcttatgccattgctgtacttcactacagcatggtcaattgcaggattcgcaagtatcgcaacattcatattctataaggaatacttttatgaagaatgaaaaaactgctacttgcgccaacaagtaacagtgacaaacgattaacaaaattaattcattttcaatataaaacgaaaaacggaggaagtcaactatgactaaaaattataaagacatgacgcaggaagaattaagagatttattggctgaaaagaatggagaattgtttgaagtagtgaatgaaatcaataaagaaactgaatttgccgttttacttttttcaactgtaggggttagcaatggagatactacatcatcgtcacattgtgcgcttggggatattgtaggtcttgctaatttattgaataacgaaaatgattaccacgatatcgctaatgttatcgaaatgtataaattaaaaaaacttttaggtctagctgacaacaaggaggacgagaatgatgtattacaaaacgggtgacgtatgtcaaaaaataattaatgtagatggctttgattttcgattaagagttaagaaacgagcatatagcgtcgaaatagttgttttagatcatgaggggaattcaattgacgggatactagtttctgacgagaacgatctatacacagcgttagatattttgaaacaaagtatttatgaatggattgaaaataacacagatgaacaggacaaactaatgaacttagtcatgaaatggtaggtataagcatgagagacacagaaagaaatatattgaatatttttaagacgttattcgacgaatatactttgtcaaaccaacgagcattattggaaattgaacgtaatcatcacggatacttatcgattaatttcctgcactatcacgacagttacaaaacaaacaataagcttgtgcagatacatgaaatcaatccagacagccatgaacgaataaaaaatttaattatcgaggtgctaagaggtcatcggaagattaaaaaaggagcatgaggaaagatatgaaaataaataagttaactatatcgaactttgctggaatcaaagaagtaacatttaactttgacggtaaagatgcaaaaatatacggcaataatgcgactggtaagactacaacagcaaccgcattacaatggctgcttttcgataaaggtttggacggatcaaccaaatcatttaaccctgtacctttaaacgaaaaaaacgcagaaaattatgagttaattccgactgttttcgcagaatttgaaatcgacggaaaaattacgacttttaaaaaagagtcacatcctaaatacacaataaatcaaaaaacgaatcgcaaggaatactcacgaagtcgaacgaagaaacaatatatcaatgatgaatcaataaaagtaaaggattataaagctcgtattgatgaactgattgatgaagatgtattcaagttaattacgaaccctcaagcatttaacttactagattggaagaagcgaagaagtttgttgtttgaaattgctaaaccaatcaatgatgaggatgtcattaaaacaaatgatgattttaaagaattaaataatattcttggagatcatgaaattgaaacaaagaaaaagattcttacggacaagataaaacagattaacaaagatatcaaagatattccgatacgtattaaccaaacacaacaaaataagcaggatgtaccagaattcgataacgatagatacgcaattatcaaacaagaaattgagcaacttgaaaatgagcgtatagatattcaaaacggtaaggaagaaattaatttgcgtaatcaattagctgataaacaatcagaattgaaacgcatagaagacaataacagcgcaagtaatgagaacaaaatccatgctttaacaaatgaattacacgttgaaaatggaacggtagcaaaccttaaaacgagattaaagcaaaacaaacaacaaatcacacatgaagaaaatagacgtaatcaattattggaaaatcacaaaggactaaaaagtgatttagaaaaatctaaaaatcaaaaatttgaacatcttgatgacaatgtatgtagttgttgtggtcaacagttaccaactgaacaagtgaatgaggcaagagaaaaagctttacagaaattcaatgtaaaaaaatcgaaagaattagaaacaatacaaacatctatcaatcacattatttcagaaggcaagaaaataaagccaatcatcgagaagttagaggatgacaataataatcttcaaattaaaatcaacgaagcagaagagcgttcagcaagaatacaaaacaaaattaataagttgaaaacgactcacgttgacgttacgcaaactgacgaatacaaagcagtaatgttagagataaatgagattaatcaaaaacgctctaacatcaggaaaactattcaagataaagtttcaggaatagatgacaaaataagcgaacttactcaagaaaaatcagaaattgaagtgtcaagatcaatcgaaaaatcaaataaacatctagatgatgttatttctgaattaagaaatgaagaagacagattattggatgaaaaagaaaagtattcacatgacctttatatcttaaagaaatttacaacaacaaaagtcaaaatgcttactgaaaatatcaataacgaatttgatattgctgaatttaagttattcaataccttagttaacggcgaattagaagaaacatgttccacaacagttaacggcgtcgaatacgacagcggtttaaataacgcctcaagaattaatgttggcttagatatcatcaatacactgtcaaaacattttaaagttacagcaccaatatttattgataatgctgaatcagtaacagagcttatcaaaacagaatcacaacaaattcaattgatagtaaatgaacaagataaaaaattaagaatggagactatataaaatgactgaaaataataaattacaaactattgaacaacaattagtacaagaaaagaacgtatctgacaacgtattaaacaaagtgagagttttagagtcacaaggcaatttggaattgccaaatgattattcaccaagtaatgccatgaaacaagcatggttacaaatcagccaagataacaaattaatgagttgtaacgatacaagcaaagcaaatgccttattagacatggtaacgcaaggtttaaatccagctaaaaatcaatgctactttattccttacggcaacaaaatgcagttacaacgtagctatcacggtaatgtaatgatgttaaaacgtgatgcaggtgctcaagatgttgttgctcaagtgatttataaaggcgatacattcaagcaagaaatgggagaaacaggacgtatcaaagcgattaaacacgaacaagacttctttaacatcgacaaagaaaacattatcggtgcgtactgcacaatcgtatttaatgatggacgagataactatattgaagtcatgactattgaacaaattaaacaagcatggatgcagtcatcaatgattaaagatgaaaaagcattacaaaattctaaaacacataataatttcaaagaagaaatggctaaaaaaacagttatcaatagagctgctaaacgttatatcaacacatcaacagatagcaatattttcaaatacgcacaagaatccgaacaacgtcaacgcaaagaagtgttggacgcagaagttgaagaaaatgcaaatcaagaacaattggactttgaacaaccagttcttgaagaagcacaatacacagaattagaaaatgataagcctattgatgtatctgactttgaagaaataaaagaacctgcaacagaaaaagaaagcgaagaagagccattttaattgaaacaatagcaactggttcaagtggtaactgctacgtcttaaatgatggacgtactacgttactacttgaggcaggtataaaatttgaatgtgttcaaaagcattttaaatataaaacaagacatatagcagggtgtcttatcacacacgaacatggtgatcatgcaaagtacacaaagcagtttgtcgacaatggtgtaatcagctatatgactgctggaacacaacaagctatgaattttgaaagtcatcgcttatgcacgattaaggcaaagcaagagctgcgaataggcacatggtcaattctaccgtttgacatcgaacatgatgctaacgagcctgtggctttcttattacaaagtacattaggttataaggttctgtatgttactgatacaaagtatttgaaatacaaatttaacggcattacgcacatgatgttagaagttaattatatctatgaacaaatgcaggaaaacataaaaaacggcagtgtgcacagcacattagcaaatagaattatggagtctcattttagcttagaacatgctatcggaatgttaaaagcaaatgatttaactagactcgaagaaatacatttaattcatttaagtagccaaaattcaaatgcaaaatacattaaaagtgaaatacaaaaagtgacgggcgtgcccgtttatgttggaggtttataaatgataaacagaacaatattagttggtcgtttaactagagacccagaattaaggaccactcaaagtggtgtaaatgtagcatcattcacattagcagttaaccgtacatttacaaatgcacaaggcgagcgcgaggcagactttataaatgtcatcgtatttaaaaaacaagcagagaacgttaataaatacctatctaaaggatcgttgacgggcgtagatggtaggttacaaacgcggaattatgaaaataaggaaggtcaacgtgtatatgttacggaagttattgctgatagtattcaatttttagaaccgaaaaactcaaatgacactcaacaagatttataccaacaacaagtacaacaaacacgtggacaatcgcaatattcaaataacaaaccagtaaaagataatccgtttgcgaatgcaaatggtccgattgaaatagatgacgatgatttaccattctaatttaaccggtttgaaagtgaggtgtgtatatgactggttggataagtattgatcgctcaattcaaaatcattggctatttaaagaaaagagaacattttcaaagtttgaagcatggatatatttactcatggaagcgaatcattcaaaggcaaaagtgcctattggaaaccaaattgtaaccgtagaaagaggacaaagattaacatcgattttgaccttgtctgacctttttaactggtcacgatttaaagtgaaaaccttccttgacttactcgagagtgatggaatgttagaagtcaaaacaacatcaaaatacacccttataaccattgtcaattatgacttttatcaaagtgagcagggcaggaaccaacatcaaaacgacatcaaaccaacatcaaaacaacatcagtcaaacatcaacccaacatcaaaacaacatcaaaccaacacaaacaataatgataataaagataataatgaaaagaatgtgaataatgagaagaagaaggtaaccgccttcgacttcttccaagataacggattcggtttcataactccttacaatttagacgatttaaattattatcttgattcatttgaaaatgattcagatcaaatagttaccgcatcacttaaaatcgctaaagatagaaacaaagttacttggggatatgctaaaagcattttgaatacatggcttaatgcaaacttgaaatctattgaacaagtacgtgcatttgaaaagcaacaacttgaaagcaaaaaacaaaattataaacctttcgttaaacaatcaaaagaaaaaacacccaaatggctcacagacagcacgagagaaacgaaaacgccggaagtagatgaaaaccttgagaaagacagagaagcttttattaagcgtctaaatagcaaatgggagtgattgaaaatggatgcatttgataaatactatctatttgatcatgacggcaacaaaatgttttcagttacaccacattttaaagatggtcggcatttagttgttggattaaaacatacaaaattcaatggtcgacgttggtacttagatgattatgaattaaaaacacttattgataatgaacaaatggagttaggacaccaaacaagcttatttgaatatatatgagggattacatggaaatagaaattaaatttaatgaagtgtttaatgcgccgatggggtcgcctcgtccacgctttcgtaatacaggtagatatgcacacacatatatgcctacaaaatatacagaacataaaaaatatttacaaaatcaaatgccaaagctaaatctagaaaatgcattaaaaattgaattagagttttactttccattgcttaaatcatggtcgaagaaaaagaaaaacgaaatggttgggcagtataaagtgactaagccggatatcgacaacttaattaaaacggtattagatgcttgtaatggccatttatggaaagacgataaccaaattacagaaataactagctcaaagcgttatggaattgagcccaaaataatcatacgaatagaagaaatataagaggtggataaaatggcgagaaaagcaagaattgtaacaataaacgataaaccttataggttcagtaaatttgaaatggaattaatagaaagtcacggtataaccgctggaatggtttctaagagagtaaaagacggttgggaactacatgaagcaatggacgcaccagaaggtacgcgtttaagcgagtacagagaaaagaaaacaatagaaagactggaacaagctagactcgaacgcaaattggaaagagagcgaaagaaagaggctgagctaagaagaaagaagccacatttgtttaatgtgcctcaaaaacatccaagaggacgttatgcgtgctacctgttggaaaacgacatattcgtgaaagttaagaagtagatcatgacagataacgcacgcaaagaatacctaaatcaattctttggatttaagagatatctgtatcaggataacgaacgagtggcacatattcatgtagtaaacggcacttattactttcatgggcatatcgtgccaggttggcaaagcgttaaaaagacatttgatactgctgaagagctcgaaatatatataaagcaacatggtttggaatacgaggaacagaagcaactaactttattttagaggagatggaaatgatgaatgctgaaaagcatatgcaaatgatgcaaatgttacaaaattgtgtgattgataagtatgtatcacacgacgaatacgaagagttaattgccatagataagcatggtaataaaatgtttattaaattttatccgaatacggaggatgacactaatgaataatcgcgaacaaattgaacaatcagttataagtgctagtgcgtataacggtaatgacacagagggattactaaaagagattgaggacgtttataagaaagcgcaagcgtttgatgaaatacttgagggaatgacaaatgctattcaacattcagttaaagaaggtgttgaacttgatgaagcagtagggattatggcaggtcaagttgtctataaatatgaggaggaacaggaaaatgagcattagtgtaggagacaaggtttttaatccagaaacaaattcaactttagaaattgtacaacttgttggcgatattagagacacgcattacaagttatctgacggatctattattagtcttatagactttgttgttaaaccaattcatttaatcaaggaggagcaggaaaatgactaacacattacaagtaaggctattatcagaaaatgctagaatgcccgaacgaaatcataagacggatgcaggttatgacatattctcagctgaaactgtcgtacttgagccacaagaaaaggcagtgattaaaacagatgtagctgtaagcataccagagggctatgtcgggctattaactagccgtagtggtgtaagtagtaaaacacatttagtgattgaaacaggcaagatagacgccggatatcacggcaatttagggattaatattaagaatgatgaagaacgtgatggaataccctttttatatgatgatatagacgctgaattagaagatggattaataagcattttagatataaaaggtaactatgtacaagatggaagaggcataagaagaatttaccaaatcaacaaaggcgacaaactagcacaactggttatcgtgcctatatggacacctgaactaaagcaagtggaggaattcgagagtgtttcagaacgtggagcaaaaggcttcggaagtagcggagtgtaaagacatcttagatcgagtcaaggaggttttggggaagtgacacaatacttagtcacaacattcaaagattcaacaggacgtaaacatacacacataactaaagctaagagtaatcaaaggtttacagttgttgaggcagagagtaaagaagaagcgaaagagaagtacgagaaacaagttaaaagggatgcagttattaaagtgggtcagttgtttgaaaatataagggagtgtgggaaatgattaaaaaacttaaaaatatggatgggttcgacatctttattgttggaatactgtcattattcggtataaccgcattgctacttgttgtcgcattgcctatctatacagtggctagttaccaaaacaaagaagtacatcaagggacaattacagataaatataacaaaagacaagataaagaggacaaattctatattgtattagatgataaacaagtcatcgaaaactcagacttattcttcaaaggaaagtttgatagcgcagacatacaagctaggttaaaagtaggtgataaagtaaaagttaagacgattggatatagaatacactttttaaatttatatccggtcttatacgaagtaaagaaggtagataaaaaatgattaagcaaatactaagattattattcttactagcgatgtatgagttaggtaagtatgtaactgagcaagtatatattatgatgacggctaatgatgatgtagaggcgccgagtgattacgtctttcgagcggaggtaagtgagtgatgtggattactatgactattgtatttgctatattgctattagtttgtatcagtattaatagtgatcgtgcaagggagatacaagcgctcagatatatgaatgattatctacttgatgaagtagttaaaactaaaggatacaacgggttaaaagaatacaggattgaattaaagcgaatgaataacgatattaaaaagtaatttatattatcggaggtattgcatgtataacaggaaagaaatacgtgaaatgatagataactacaagtggatgaaaaatataatagacagtaaagtctacgataacgaaagtacatcaattgcacaatacggttatcaatctgcgatgccaaaagctaaaggcacgactagcaataaagtgttagtgaaagttataaacaaaaacaaagcgcttagaaagtacgattacttgattaataagatagcgttcattgatgaatacgaagaatacatcacgaatgaaaaagattatcatattttacaaatgttaaaacaacgagaaagccataataggattatgagtattcttgatataggcagagacaatttttattctagagtaaaagatatagtaaatatactttataacttgcaaacaagaaaccgacacatcgtacacatcggacagttcggacacatcgtacaaatcgtacaaatcgtacacatcggactaattttgatgctacatattgttttttattataattgctatgtagcaaaacatttatatttattttgaactctcacattaagtgagggtttttatttttataaacaagaggtggagaatggagatatcaaagtaccaagagatagctacacgtacacacaatgatgaattgaatttaaatgaatctattacttgttacggcttaggtttaactcaatctacaggcaatgttacagatctaattaaacagcatatgttttgtaatgtaccgatagataaaggaattatgataaatgaacttagcgaagcattgtggaatatagctaatcttactaacgtgttaggtattaacttggatgagatagctggtcatagtgttaacactatcttgatgaataaacctaatcagactatcaatttagacaatggtataaaacaaggagacaaagtattgtttcaaggtagtaaatatcttgttgatggatcgataggaaacttattgttaattagcaatgataaagatgatagacaagtaactgtgcaagatgttaagaaagtcgacaaggagtgatgtgcattgtctattatgaagcgatgtggtcatccaacatgtaatgtattgattaatcataatgaaagttattgtgataaacacaagcaatatgcaaatgaaaattacaatgatttgagacgtcgaaacgatccagagtatttaagattttataaatcgaaaacgtggcaaaacatgcgtcgaattgtattgttagaacatgactttatttgtgtttcttgtggcaatcaagcgactatggttgaccatattgtaccaacaaaaattgattgggcaagaagattagacaaaagtaatttacagcctttgtgtgatgcttgccataaccaaaagacaaaagaagatttgaagaaatattaaaaaagataaaaataggaagtcccccaaagatgaaacgggcgtcaatgaaaggttctggagaa

SEQ ID NO: 6 - DNA, 41565 bp, Unknown
  Description of Unknown: Undetermined Bacteriophage F87s/06 polynucleotide
tagggagtaaacttcgcgataattttaaaaatccatgtataacccccctcttataaccattttaaggcaggtgatgaaatggagattatagtcgatgaaaatttagtgcttaaagaaaaagaaaggctacaagtattatataaagacatacctagcaataaattaaaagtagttgatggtttaattattcaagcagcaaggctacgtgtaatgcttgattacatgtgggaagacataaaagaaaaaggtgactatgatttatttactcaatctgaaaaggcgccaccatatgaaagggaaagaccagtagccaaactatttaatgctagagatgctgcatatcaaaaaataatcaaacaattatcggatttattgcccgaagagaaagaagacacagaaacgccatctgatgattacctatgattagtaataaatacgttgatgaatatataaatttgtggaaacaaggaaagataattttaaataaagaaagaattgatctctttaattatctacaaaaacatatatattcacgagatgatgtatattttgatgaacagaaaatcgaggattgtatcaaatttattgaaaaatggtattttccaacattaccatttcaaaggtttatcatagctaatatatttcttatagataaaaatacagatgaagctttctttacagaatttgctattttcatgggacgtggaggcgggaaaaacggtctaataagtgctattagtgattttctttctacgcccttacacggagttaaagaatatcacatctccattgttgctaatagtgaagatcaagcaaaaacatcgtttgatgaaatcagaaccgttttaatggataacaaacgaaataagacgggtaaaacgccaaaagctccttatgaagttagtaaagcaaaaataataaaccgtgcaactaaatcggttattcgatataacacatcaaacacaaaaaccaaagacggtggacgtgaggggtgtgttatttttgatgaaattcattatttctttggtcctgaaatggtaaacgtcaaacgtggtggattaggtaaaaagaaaaatagaagaacgttttatataagtactgatggttttgttagagagggttatatcgatgcaatgaagcacaaaattgcaagtgtattaagtggcaaggttaaaaatagtagattgtttgctttttattgtaagttagacgatccaaaagaagttgatgacagacagacgtgggaaaaggcgaacccaatgttacataaaccgttatcagaatacgctaaaacactgctaagcacgattgaagaagaatataacgatttaccattcaaccgttcaaataagcccgaattcatgactaagcgaatgaatttgcctgaagttgaccttgaaaaagtaatagcaccatggaaagaaatactagcgactaatagagagataccaaatttagataatcaaatgtgtattggtggtttagactttgcaaacattcgagattttgcaagtgtagggctattattccgaaaaaacgatgattacatttggttaggacattcgtttgtaagacaagggtttttggatgatgtcaaattagaacctcctattaaagaatgggaaaaaatgggattattgaccattgtcgatgatgatgtcattgaaattgaatatatagttgattggtttttaaaggctagagaaaaatatgggcttgaaaaagtcatagctgataattatagaactgatattgtaagacgtgcgtttgaggatgctggcataaaacttgaagtacttagaaatccaaaagcaatacatggattacttgcaccacgtatcgatacaatgtttgcgaaacataacgtaatatatggagacaatcctttgatgcgttggtttactaataatgttgctgtaaaaatcaagccggatggaaataaagagtatatcaaaaaagatgaagtcagacgtaaaacggatggatttatggcatttgttcatgcgttatatagagcggatgatatagtagacaaagacatgtctaaagcacttgatgcattaatgagtatagatttctaatagaggaggtgagacatgagtattctagaaaagatatttaaaactaggaaagatatatcatatatgcttgatttagatatgatagaagatttatcacaacaagcgtatgtgaaacgtttagcgattgatagttgtattgaatttgttgcgcgagctgtcgctcaaagtcattttaaagtattggaaggtaatagaattcaaaagaatgatgtttactacaagttaaatataaaaccaaatactgacttatcaagcgatagtttttggcaacaagttatatataaactaatttacgataacgaggttttaatcgtagtaagtgacagcaaagaattacttatcgcagatagcttttacagagaagagtatgctttgtatgatgatatattcaaagatgtaacggttaaagattatacttatcaacgtactttcacaatgcaagaggtcatatatttaaagtacaacaacaataaagtgacacactttgtagaaagtctattcgaagattacgggaaaatattcggaagaatgataggtgcacaattaaaaaactatcaaataagagggattttgaaatctgcctctagcgcatatgacgaaaagaatatagaaaaattacaagcgttcacaaataaattattcaatacttttaataaaaaccaactagcaatcgcgcctttgatagaaggttttgattatgaggaattatctaatggtggtaagaatagtaacatgcctttttctgaattgagtgagctaatgagagatgcaataaaaaatgttgcgttgatgattggtatacccccaggtttgatttacggagaaacagctgatttggaaaaaaacacgcttgtatttgagaagttctgtttaacacctttattaaaaaagattcagaacgaattaaacgcgaaactcataactcaaagcatgtatttgaaagatacaagaatagaaattgtcggtgtgaataaaaaagacccacttcaatatgctgaagcaattgacaaacttgtaagttctggttcatttacaaggaatgaggtgcggattatgttaggtgaagaaccgtctgacaatcctgaattagacgaatatctagtgacgaagaactacgaaaaagcaaacgaaaatggtagtacattgaaaggtggtgatgaagatgaaagtggagattaaaggcgtcatcgtttccaacgaagataaatgggtttacgaaatgcttggtatggattcgacttgtcctaaagatgttttaacacaactagaatttagtgatgaagatgttgatattataattaactcaaatggtggtaacctagtagctggtagtgaaatatatacacatttaagagctcataaaggcaaagtgaatgttcgtatcacagcaatagcagcaagtgcggcatcgcttatcgcaatggctggtgaccacatcgaaatgagtccggttgctagaatgatgattcacaatccttcaagtattgcgcaaggagaagcgaaagatctaaatcatgctgcagaaacattagaacatgttggtcaaataatggctgaggcatatgcggttagagctggtaaaaacaaacaagaacttatagaaatgatggctaaggaaacatggctaaatgctgatgaagccattgaacaaggttttgcggatagtaaaatgtttgaaaacgacaatatgcaaattgtagcaagcgatacacaagtgttatcgaaagatgtattaaatcgtgtaacagctttggtaagtaaaacgccagaggttaacattgatattgacgcaatagcaaataaagtaattgaaaaaataaatatgaaagaaaaggaatcagaaatcgatgttgcagatagtaaattatcagcaaatggattttcaagattccttttttaatacaaaaataggaggtcataaaatgactataaatttatcggaaacattcgcaaatgcgaaaaacgaatttattaatgcagtaaacaacggtgaaccgcaagaaagacaaaatgaattgtacggtgacatgattaaccaactatttgaagaaactaaattacaagcaaaagcagaagctgaaagagtttctagtttacctaaatcagcacaaactttgagtgcaaaccaaagaaatttctttatggatatcaataagagtgttggatataaagaagaaaaacttttaccagaagaaacaattgatagaatcttcgaagatttaacaacgaatcatccattattagctgacttaggtattaaaaatgctggtttgcgtttgaagttcttaaaatccgaaacttctggcgtggctgtttggggtaaaatctatggtgaaattaaaggtcaattagatgctgcgttcagtgaagaaacagcaattcaaaataaattgacagcgtttgttgttttaccaaaagatttaaatgattttggtcctgcgtggattgaaagatttgttcgtgttcaaatcgaagaagcatttgcagtggcgcttgaaactgcgttcttaaaaggtactggtaaagaccaaccgattggcttaaaccgtcaagtacaaaaaggtgtatcggtaactgatggtgcttatccagagaaagaagaacaaggtacgcttacatttgctaatccgcgcgctacggttaatgaattgacgcaagtgtttaaataccactcaactaacgagaaaggtaaatcagtagcggttaaaggtaatgtaacaatggttgttaatccgtccgatgcttttgaggttcaagcacagtatacacatttaaatgcaaatggcgtatatgttactgctttaccatttaatttgaatgttattgagtctacagttcaagaagcaggtaaggttttaacgtacgttaaaggtctatatgatggttatttagctggtggtattaatgttcagaaatttaaagaaacacttgcgttagatgatatggatttatacactgcaaaacaatttgcttacggcaaagcgaaagataataaagttgctgctgtttggaaattagatttaaaaggacataaaccagctttagaagataccgaagaaacactataaaattttatgaggtgataaaatggtgaaatttaaagttgttagagaatttaaagacatagagcacaatcaacacaagtacaaagtaggggagttgtatccagctgaagggtataacaatcctcgtgttgaattgttgacaaatcaaatcaaaaataagtacgacaaagtttatatcgtacctttagataagctgacaaaacaagaattattagaactatgcgaatcattacaaaaaaaagcgtctagttcaatggttaaaagtgaaatcatcgacttattgaatggtgaagacaatgacgattgatgatttgcttgtcaaatttaaatcacttgaaaagattgaccataattcagaggatgagtacttaaagcagttgttaaaaatgtcgtacgagcgtataaaaaatcagtgcggagtttttgaattagagaatttaataggtcaagaattgatacttatacgcgctagatatgcttatcaagatttattagaacacttcaacgacaattacagacctgaaataatagatttttcgttatctctaatggaggtatcagaagatgaagaaagtgtttaagaaacctagaattacaactaaacgtttaaatacgcgtgttcatttttataagtatactgaaaataatggtccagaagctggagaaaaagaagaaaaattattatatagctgttgggcgagtattgatggtgtctggttacgtgaattagaacaagctatctcaaacggaacgcaaaatgacattaaattgtatattcgtgatccgcaaggtgattatttacccagtgaagaacattatcttgaaattgaatcaagatatttcaaaaatcgtttgaatataaagcaagtatcaccagatttggataataaagactttattatgattcgtggaggatatagttcatgagtgtgaaagtgacaggtgataaagcattagaaagagaattagaaaaacattttggcataaaagagatggtaaaagttcaagataaggcgttaatagctggtgctaaggtaattgttgaagaaataaaaaaacaactcaaaccttcagaagactcaggagcgctgattagtgagattggtcgtactgaacctgaatggataaaggggaaacgtactgttacaattaggtggcgcgggccttttgaacgatttagaatagtacatttaattgaaaatggtcatgttgagaaaaagtcaggaaaatttgtaaaacctaaagctatgggtgggattaatagagcaataagacaaggtcaaaataagtattttgaaacgttaaaaagggagttgaaaaattgtgattgatattttgtacaaagttcatgaagtgattagtcaagacagaattattagagagcacgtaaatatcaataatattaagttcaataaataccctaatgtaaaagatactgatgtaccttttattgttattgacgatatcgacgacccaatacctacaacttatactgacggagatgagtgtgcatatagttatattgtccaaatagatgtttttgttaagtacaatgatgaatataatgcgagaatcataagaaataagatatctaatcgcattcaaaagttattatggtctgaactaaaaatgggaaatgtttcaaatggaaaaccggaatatatagaagaatttaaaacatatagaagctctcgcgtttacgagggcattttttataaggaggaaattaaatggcaataaaacatgcaagtgcgccaaaggcgtattttaacattactggtttaggtttcgctaaattaacgaaagaaggcgcggaattaaaatatagtgatattacaaaaacaagaggattacaaaaaatagtgttgaactggtggagaactaaaaacaagcttatgctgatggtggtccaatcgaatcagggaacacagacggagaaggtaaaatttcgttacaaatgcatgctttccctaaagagattcgcaaaattgtttttaatgaagattatgatgaagatggcgtttacgaagagaaacaaggtaaacaaaacaattacgtagctgtatggttcagacaagagcgtagagacggtacatttagaacagttttattacctaaagttatgtttacaaatcctaaaatcgatggagaaacggctgagaaagattgggatttctcaagtgaagaggttgaaggtgaggcacttttccctttagttgataataaaaagtcagtacgtaagtatatctttgattcagctaacatgacaaatcatgatggagacggtgaaaaaggcgaagaggctttcttaaagaaaattttaggcgaagaatatactggaaacgtgacagagggtaacgaagaaactttgtaacaaaaccggcttcatcggaaactgcggtaaagtcggttaatataccagatagcattaaaacacttaaagttggcgacacatacgatttaaatgttgtagtagagccatctaatcaaagtaagttattgaaatacacaacagatcaaacgaatattgtatcaatcaatagtgatggtcaagttactgcggaagcacaaggcattgctacggttaaagcaacagttggtaatatgagtgacactataacaataaatgtagaagcataagagggggcaacccctctattttatttgaaaataaggagagtattataaaatggcaaaattaaaacgtaacattattcaattagtagaagacccgaaagcaaatgaaattaaattacaaacgtacttaacaccacacttcatttcatttgaaattgtatacgaagcaatggatttaatcgatgatattgaggacgaaaatagcacgatgaaaccaagagaaatcgctgacagattgatggatatggttgtaaaaatttacgataaccaattcacagttaaagacctaaaagaacgtatgcatgcacctgatggaatgaatgcacttcgtgaacaagtgattttcattactcaaggtcagcaaactgaggaaactagaaattttatccagaacatgaaataaagcctgaagatttaacatataaagcaatgttgaaaaatatggatactctcatgatggacttaattgaaaatggtaaagacgctaacgaagttttaaaaatgccatttcattatgtactttccatatatcaaaataaaaacaatgacatttctgaagaaaaagcagaggctttaattgatgcgttttaaccttaaccgtttggttagggttatttttttgaacttttttagaaaggaggtaaaaaatgggagaaagaataaaaggtttatctataggtttggatttagatgcagcaaatttaaatagatcatttgcagaaatcaaacgaaactttaaaactttaaattctgacttaaaattaaccggtaacaacttcaaatataccgaaaaatcaactcatagttacaaacaaaggattaaagaacttgatggaactatcacaggttataagaaaaacgttgatgatttagccaagcaatatggcaaggtatctcaagaacagggcgaaaacagcgcggaagctcaaaaattacgacaagaatataacaaacaagcaaatgagctgaattttttagaaaaagaactagaaaaaacaacaactgagtttgaagagttcaaaaaagctcaagttgaagctcaaagaatggcagaaagtggctggggaaaaaccagtaaagtttttgaaagtatgggacctaaattaacaaaaatgggtgatggtttaaaatccattggtaaaggtttgatgattggtgtaactgcacctgttttaggtattgcagcagcatcaggaaaagcttttgcagaagttgataaaggtttagatacagttacccaagcaacaggagcaaccggcggagagcttaagaagttgcagaattcatttaaagatgtttatggcaactttccagcagacgctgagactgtaggcggtgttttaggggaagttaacacaaggttaggtttcactggcaaagaacttgagagtgccacagagtcattcttgaaatttagtcacataacaggttctgaaggcgtacaagccgttcaattaattacgcgtgcaatgggtgatgcaggtattgaagctgatgagtatcaaagtgtacttgatatggtagcgaaagcagcacaggctagcggtataagtgttgatacattagctgatagcattactaaatacggtgctccaatgagggctatgggctttgagatgaaagaatcaatcgctttattctctcaatgggagaaatcaggtgttaatactgaaatagccttcagtggtttgaaaaaagctatatccaattggggtaaagctggtaaaaatccaagagaagaatttaagaagacattagcagaaattgaaaagacgccggatatagctagcgcaacaagtttagcgattgaagcatttggtgcaaaagcaggtcctgatttagcagatgctattaaaggtggtcgttttagttatcaagaatttttaaaaactatcgaagattcccaaggcacagtaaatcaaacgtttaaagattctgaaagtggctccgaaagatttaaagtagcaatgaataaattaaaattagtaggtgctgatgtatggacttctattgaaagtgcgtttgcaccagtaatggaagaattaatcaaaaagctatctatagcggttgattggttttccaatttaagtgatggttctaaaagatcaattgttattttcggtggtattgctgctgcaattggtcctgtagtttttggattaggcgcatttataagtacaattggcaatgcagtaactgtattagccccactattagctggtattgcaaaggctgatggattaattagttttttatcgactaaagtacctattttaggaacagtcttcacagcattaactggtccaattggtatcgtgttaggtgtactggctggtttagcagtcgcatttacaatagcttataagaaatctgaaacattcagaaattttgttaatggtgcaattaacagtgttaaacaaacgtttagtaatttcattcaatttatccaacctttcattgattccgttaaaaacgtctttaaacaagcggtttcagcaatcgttgatttcgctaaagatatttggagtcaaattaatggattctttaatgaaaacggaatttctattgttcaagcgcttcaaaatatatgcaattttatcaaagctatatttgaatttatcttaaattttgtaattaaaccaatcatgtttgcgatttggcaagtgatgcaatttatttggccggcggttaaagccttgattgtcagtacttgggagaatataaaaggagtaatacaaggtgctttaaatatcatacttggctttattaagttcttttcaagtttattcactggtaattggcgaggtgtttgggacggtattgtgatgatactaaaaggcactgtgcagttaatttggaatttaatacaactgtggtttgtaggtaagattctaggtgttgttagatactttggtggattgcttaaaggtttaatatccggtatctggggtgttatcaaaggtattttcacaaaatcattatctgcaatttggaatgcaacgaaaagtatttttggtttcttatacaatagtgttaaatctattttcactaatatgaaaaactggttatctagtacgtggaataatatcaaaagcaataccgtcggcaaggctcattcgttatttacgggtgtaaggtctaaattcacaagtttatggaatgcgacgaaagatatatttactaaattaagaaattggatgtcaaacatctggaactctattaaagataacacggtaggtatagcgggtcgcttatgggatagagtgcgtaacatctttggaagcatgcgtgacggtttaaaatctatcattagtaaaattaaagatcatatcggtggtatggtagacgctgttaaaagaggtcttaataaattaattgaaggtttaaactgggtcggtggtaagttgggtatggacaaaataccgaagttacacactggtactgaacatacacatactactacaagattagttaagaacggtaagattgcacgtgacacattcgctacagttggggataagggacgcggaaatggtccaaatggtttcagaaatgaaatgattgaattccctaatggtaaacgtgtaatcacaccaaatacagatactacggcttatttacctaaaggctcaaaagtatacaacggggcacaaacttattcaatgttaaacggaacgcttccgagatttcatttcggtactactatgtggaaagatattaaatctagtgcatcatcggcatttaactggacaaaagatcaaataggtaaaggtaccaaatggcttggcgataaagttggcgatgtaatggactttattgataatccgggtaagcttttaaattatgtgctcaaagcgtttggtgttgactttagctctctaactaaaggtatgggtattgttggcgatataacaaaagcgtcttggaataagattaaaagtaaggcgattaattggataaaagaaggattagagagccaagcgggagatggttctgtgtttgatagtttcagaatactacaaccttattcagcaccgccaaaacctcctaaccccaattatccatttaacggaggcgttcatcatggtgttgactatgatacgccgaccggtacccctatacgtacgccaatgggtggacgtgttagaagttggtatgacaactatggtggcggtaaagcaattactgttcaaaaaggtcgaacatttttgtggttcatgcacttatctgaacaattgcgtagaacaggtgaacaaattaaagctggtcaattaattggtaaatcaggtaatacaggttctatgactaattaccgccatttacatttccaagtcaatcaaggcggagagtccaataggtattcgacagaccctattccttggttacggaaaaacgacaaaactggtggaaagaattcacctggagggagtggttctgaaaatgcgcgcagagcgattagaacagctcaaaatatacttggaggtcaatacaaagctagctggattacacacgaaatgatgcgtgtagcaagacgtgaatccaattatacagctaatgcagttaataattgggatagcaacgcaagagctggtacaccttcaagaggtatgttccaaatgatagatccttcatttagagcgtacgcaaagtcgggttacaataatcctcttaacccaactcatcaagctatatcggctatgagatatattgtgggtaaatgggtaccaagaacgggctcatggagagctgcgttcaaacgcgctggtgattacgcatatgctactggtggcaaagtctacaacggattgtaccacttaggagaagaaggatatccagagtgggttattcctactgatcctgcacgtaaaaacgaagcaatgaagatgttacattatgcagcagcagaagtaagagggagaaaagcgagtaaaaataagcgtcctagtcaattgtctagtgtaaatgggtttgatgacccaagcttattattgaaaatgattgaacaacagcaacaacaaatagctttattactgaaaatagcgcaatccaacgatgtgattgcagataaagattatcagccgattattgacgaatacgcttttgataaaaaggtgaacgcgtctatagaaaagcgagaaaggcaagaatcaacaaaagtaaagtttagaaaaggaggaattgctattcaatgatagacactattaaagtgaacaacaaaacaattccttggttgtatgtcgaaagagggtttgaaataccctcttttaattatgttttaaaaaactgaaaatgtagatggacgttcggggtctatatataaagggcgtaggcttgaatcttatagttttgatatacctttggtggtacgtaatgactatttatctcacaacggctttaaaacacatgatgacgtcttgaatgaattagtaaagttttttaactacgaggaacaagttaaattacaattcaaatctaaagattggtactggaacgcttattttgaaggaccaataaagctgcacaaagaatttgcaatacctgttaagttcactatcaaagtagtactaacagacccttacaaatattcagtaacaggatataaaaatactgcgatttcagaccaagtttcagttgtaaatagtgggactgctgacactcctttaattgttgaagcccgagcaattaaaccatctagttactttatgatcactaaaaatgatgaagattattttatggttggtgatgatgaggtaaccaaagaagttaaggattacatgcctcctgtttatcatagtgagtttcgtgatttcaaaggttggactaagatgattactgaagatattccaagtaatgatttaggtggtaaagtcggcggtgactttgtgatatccaatcttggcgaaggatataaagcaactaattttcctgatgcaaaaggttgggttggtgctggcacgaaacgagggctccctaaagcgatgacagattttcaaattacctataaatgtattgttgaacaaaaaggtaaaggtgccggaagaacagcacaacatatttatgatagtgatggtaagttacttgcttctattggttatgaaaataaatatcatgatagaaaaataggacatattgttgttacgttgtataaccaaaaaggagaccccaaaaagatatacgactatcagaataaaccgataatgtataacttggacagaatcgttgtttatatgcggctcagaagagtaggtaataaattttctattaaaacttggaaatttgatcacattaaagacccagatagacgtaaacctattgatatggatgagaaagagtggatagatggcggtaagttttatcagcgtccagcttctatcatagctatctatagtgcgaagtataatggttataagtggatggagatgaatggattaggttcattcaatacggagattctaccaaaaccgaaaggcgcaagggatgtcattatacaaaaaggtgatttagtgaaaatagatatgcaagcaaaaagtagttgtcatcaatgaggaaccaatgttgagcgagaaatcgtttggaagtaattatttcaatgttgattctgggtacagtgaattaatcatacaacctgaaaacgtctttgatacgacggttaaatggcaagatagatatttatagaaaggagatgagagtgtgatacatgttttagattttaacgacaagattatagatttcctttctactgatgacccttccttagttagagcgattcataaacgtaatgttaatgacaattcagaaatgcttgaactgctcatatcatcagaaagagctgaaaagttccgtgaacgacatcgtgttattataagggattcaaacaaacaatggcgtgaatttattattaactgggttcaagatacgatggacggctacacagagatagaatgtatagcgtcttatcttgctgatataacaacagctaaaccgtatgcaccaggcaaatttgagaaaaagacaacttcagaagcattgaaagatgtgttgagcgatacaggttgggaagtttctgaacaaaccgaatacgatggcttacgtactacgtcatggacttcttatcaaactagatatgaagttttaaagcaattatgtacaacctataaaatggtattggatttttatatagagcttagttctaataccgtcaaaggtagatatgtggtactcaaaaagaaaaacagcttattcaaaggtaaagaaattgagtatggtaaagatttggttgggttaactaggaagattgatatgtcagaaatcaaaacagcattaattgctgtgggacccgaaaatgacaaaggaaagcgtttagagttagttgtgactgatgacgaagcacaaagtcaattcaacttacctacccgttatatttggggaatatacgaacctcaatcagatgatcaaaatatgaatgaaacacggttgcgttctttagccaaaacagagttaaataaacgtaagtcggcagttatgtcatatgagattacttctactgatttggaagttacgtatccgcacgagattatatcaattggtgatacagtcagagtaaaacatagagattttaacccgccattgtatgtagaggcagaagttattgccgaagaatataacataatttcagaaaatagcacatatacattcggtcaacctaaagagttcaaagaatcagaattacgagaagagtttaacaagcgattgaacataatacatacaaaagttaaacgataatattagcaatatcaacactatagttaaagatgttgtagatggtgaattagaatactttgaacacaaaatacacaaaagtgatacaccgccagaaaatccagtcaatgatatgctttggtatgatacaagtaaccctgatgttgctgtcttgcgtagatattggaatggtcgatggattgaagcaacaccaaatgatgttgaaaaattaggtggtataacaagagagaaagcgctattcagtgaattaaacaatatttttattaatttatctatacaacacgctagtcttttgtcagaagctacagaattactgaatagcgagtacttagtagataatgatttgaaagaggacttacaagcaagtttagacgctgtgattgatgtttataatcaaattaaaaataatttagaatctatgacacccgaaactgcaacgattggtcggttggtagatacacaagctttatttcttgagtatagaaagaaattacaagatgtttatacagatgtagaagatgtcaaaatggccatttcagatagatttaaattattacagtcacaatacactgatgaaaaatataaagaagcgttggaaataatagcaacaaaatttggtttaacggtgaatgaagatttgcagttagtcggagaacctaatgttgttaaatcagctattgaagcagctagagaatccacaaaagaacaattacgtgactatgtaaaaacatcggactataaaacagacaaagacggtattgttgaacgtttagatactgctgaagctgagagaacgactttaaaaggtgaaatcaaagataaagttacgttaaacgaatatcgaaacggattggaagaacaaaaacaatatactgatgaccagttaagtgatttgtccaataatcctgagattaaagcaagtattgaacaagcaaatcaagaagcgcaagaagctttaaaatcatacattgatgctcaagatgatcttaaagagaaggaatcgcaagcgtatgctgatggtaaaatttcggaagaagagcaacgcgctatacaagatgctcaagctaaacttgaagaggcaaaacaaaacgcagaactaaaggctagaaacgctgaaaagaaagctaatgcttatacagacaacaaggtcaaagaaagcacagatgcacagaggaaaacactgactcgctatggttctcaaattatacaaaatggtaaggaaatcaaattaagaactactaaagaagagtttaatgcaaccaatcgtacactttcaaatatattaaacgagattgttcaaaatgttacagatggaacaacaatcagatatgatgataacggagtggctcaagctttgaatgtggggccacgtggtattagattaaatgctgataaaattgatattaacggtaatagagaaataaaccttcttatccaaaatatgcgagataaagtagataaaaccgatattgtcaacagccttaatttatcaagagagggtcttgatatcaatgttaatagaattggaattaaaggcggtgacaataacagatatgttcaaatacagaatgattctattgaactaggtggtattgtgcaacgtacttggagagggaaacgttcaacagacgatatttttacgcgactgaaagacggtcacctgagatttagaaataacaccgctggcggttcactttatatgtcacattttggtatttcgacttatattgatggtgaaggtgaagacggtggttcatctggtacgattcaatggtgggataaaacttacagtgatagtggcatgaatggtataacaatcaattcctatggtggtgtcgttgcactaacgtcagataataatcgggttgttctggagtcttacgcttcatcgaatatcaaaagcaaacaggcaccggtgtatttatatccaaacacagacaaagtgcctggattaaaccgatttgcattcacgctgtctaatgcagataatgcttattcgagtgacggttatattatgtttggttctgatgagaactatgattacggtgcgggtatcaggttttctaaagaaagaaataaaggtcttgttcaaattgttaatggacgatatgcaacaggtggagatacaacaatcgaagcagggtatggcaaatttaatatgctgaaacgacgtgatggtaataggtatattcatatacagagtacagacctactgtctgtaggttcagatgatgcaggagataggatagcttctaactcaatttatagacgtacttattcggccgcagctaatttgcatattacttctgctggcacaattgggcgttcgacatcagcgcgtaaatacaagttatctatcgaaaatcaatataacgatagagatgaacaactggaacattcaaaagctattcttaacttacctattagaacgtggtttgataaagctgagtctgaaattttagctagagagctgagagaagatagaaaattatcggaagacacctataaacttgatagatacgtaggtttgattgctgaagaggtggagaatttaggattaaaagagtttgtcacgtatgatgacaaaggagaaattgaaggtatagcgtatgatcgtctatggattcatcttatccctgttatcaaagaacaacaactaagaatcaagaaattggaggagtcaaagaatgcaggataacaaacaaggattacaagctaatcctgaatatacaattcattatttatcacaggaaattatgaggttaacacaagaaaacgcgatgttaaaagcgtatatacaagaaaataaagaaaatcaacaatgtgctgaggaagagtaatccttagcactatttttatacaaaaatttaaggaggtcatttaattatggcaaaagaaattatcaacaatacagaaaggtttattttagtacaaatcgacaaagaaggtacagaacgtgtagtatatcaagatttcacaggaagttttacaacttctgaaatggttaaccatgctcaagattttaaatctgaagaaaacgctaagaaaattgcggagacgttaaatttgttatatcaattaactaacaaaaaacaacgtgtgaagtagttaaagaagtagttgaaagatcagatttatctccagaggtaacagttaacactgaaacagtatgaaaagctatgagttagatactcataatctttattcttttagaaagcgggtgtactgaattggggtggttcaaaaaacacgaacatgaatggcgcatcagaaggttagaagagaatgataaaacaatgctcagcacactcaacgaaattaaattaggtcaaaaaacccaagagcaagttaacattaaattagataaaaccttagatgctattcaaaaagaaagagaaatagatgaaaagaataagaaagaaaatgataagaacatacgtgatatgaaaatgtgggtgcttggtttagttgggacaatatttgggtcgctaattatagcattattgcgtatgcttatgggcatataagagaggtgaataaaatgtttaaactaatctttggttatagtttctggacatgtttttggttcggtaaatgtaaataagttttagtcagtgcttcggtactgactttttatttattgttgtaattatggtaatatgcagaagtgagcaagttggatagatggtggctatctgagtataaggaggtggtgcctatggtggcattactgaaatctttagaaaggagacgcctaatgattacaattagtaccatgttgcagtttggtttattccttattgcattgataggtctagtaatcaagcttattgaattaagcaataaaaaataaccatcgctaactttggctggtttcgatggttaaatggttattaatttaatctttaatctaaaatagccaccgtctttttaacgggctcattagggtaacatgtttgcgcatgttgccctttttctatatataaattaacacaccataatataaatatcaaatagacggcttattagtcgtctttttattttgggtaaaaggagataagaatatgattaattggaaaattagaatgaaacaaaaatcattttgggtagcgatattgtcagctatctttttatttgctcaaaacatcgcaaaagctattgggtatgatatccaagtttatacagagcaattaacagacggtttaaacgctatattaggatttttagtattaactggtgtgattcaagacccgactactaaaggtataggtgatagccaccaagctttagaatatgaagaaccaagaagaaaatactaggaggtaaaataatgaaaacatacagtgaagcaagagcaaggttacgttggtatcaaggtagatatattgattttgacggttggtatggttaccaatgtgcagatttagcagttgattacatttattggttgttagaaattagaatgtggggaaatgcaaaagatgcaatcaataacgattttaaaaacatggcaacagtatatgaaaacacaccatcgtttgttccacaaataggtgatgtggctgtatttaccaaaggaatatataaacaatacggtcatattggtttagtgtttaatggtggtaatacaaaccaatttttaattttggaacagaactatgacggtaacgcaaatacgcctgcaaagttacgttgggataattattacggctgtactcactttattagacctaagtataaaagtgagggcttaatgaataagatcacaaataaagttaaaccacctgctcaaaaagcagtcggtaaatctgcaagtaaaataacagttggaagtaaagcgccttataaccttaaatggtcaaaaggtgcttattttaatgcgaaaatcgacggcttaggtgctacttcagccactagatacggtgataatcgtactaactatagattcgatgttggacaggctgtatacgcgcctggaacattaatatatgtgtttgaaattatagatggttggtgtcgcatttattggaacaatcataatgagtggatatggcatgagagattgattgtgaaagaagtgttttaattcttaggttaaaatgttaaatatttgttaattattttttaatgtaattttagtttcttttaatattttattgatttttaatattttctcaatataaaatgaagttgttgatatttatcatcttaaataagggtgttagctataaaaagagataaataaaaacaaatatattatatttggaggaagcgccatgctcaaaagaggtttattatttttaactgttttattgttattattctcattttcttcaattactaatgaggtaagtgcatcaagttcattcgacaaaggaaaatataaaaaaggcgatgacgcgagttattttgaaccaacaggcccgtatttgatggtaaatgtgactggagttgatggtaaaggaaatgaattgctatcccctcattatgtcgagtttcctattaaacctgggactacacttacaaaagaaaaaattgaatactatgtcgaatgggcattagatgcgacagcatataaagagtttagagtagttgaattagatccaagcgcaaagatcgaagtcacttattatgataagaataagaaaaaagaagaaacgaagtctttccctataacagaaaaaggttttgttgtcccagatttatcagagcatattaaaaaccctggattcaacttaattacaaaggttgttatagaaaagaaataaaacaaaatagttgtttattatagaaagcaatgtcttgattgaatatgtgtagtgaaaattatctttcatcaaattctcattcatgcacgaatggttcttccccacctaatcagatattaggtgacttatggggagaaatcagttaggatgaaaaagtggataatccttttttaggcaggtacttcggtacttgcctatttttttatgttataatctttctagacgtattcaaaggacgtctttttagattgtatgttatagctagctttcgggctagttttttgctatgatgtgttacacatgcatcaactatttacatctatccttgttcacccaagcatgtcactgggtgtttttttcttatgatagagagcatggttttcatactactcccccgtagtatatatgactttagcattcccgtataatagtttacggggtgctttttatgttataattaagtgtatatagtaggagtgaactatatagcctgttaagtggcctagtaacctaacacttatcctgcaattgatatcctttttgcccttcactcgatacatatatctcaacaacatagaaatattacagtcgctacaccgcatcttaaatggtgtggttatttttattggaagtgtgtatcaggtatcagtaatgttaaaacaccagctaaaaatgaaaagaattcaccagtgccagcaggttatacactcgataaaaacaatgtaccgtataaaaaagagactggttattacacagttgccaatgttaaaggtaataacgtgagggatggctattcaactaattcaagaattacaggtgtattacccaataacgcaacgatcaaatatgacggcgcatattgcattaatggctatagatggattacttatattgctaataatggacaacgttgttatatagcgacaggagaggtagacaaggcaggtaatagaataagcagttttggtaattttagcgcactttgaaaaaagtgtgtaaagtttcatatgaagttaattaatttattatagaatagtttgaaattatgctataatcattttagacacagcaatgtgttcaaattttcatctattcataagctagccttcgggctagtttttttgtgctatatatttgttttaattaaataaaattagataatgcaatagtagccattttatgttaatattaccttgggcgttttcaaggagcgcctttcattttttattgtattgctccccttcgggctagtatattaaatttatttttgcgctttccaaatcaatgtatatgtgttatattgtttatgggaagtaggtaagcatttcggtgcttacctttttttgtttttctataaatacaataaggtatgtcaatttgataatttattaattttcatttaataagaagatctatatagttaatgaataattaatgtactttttttagttagtcattaaaataaattagtactaattactaaggagaataaaaaatgaaaattagaaaatctatacttgcgggaactttagcaatcgttttagcatcaccactagtaactaatctagataaaaatgaggcacaagctagcacaagcttgccaacatcgaatgaatatcaaaacgaaaagttagctaatgaattaaaatcgttattagatgaactaaatgttaatgaattagctactggaagtttaaacacttattataagcgaactataaaaatttcaggtcaaaaagcaatgtatgctcttaagtcaaaagactttaagaaaatgtcagaagcaaaatatcaacttcaaaagatttataatgaaattgacgaagcactaaaaagtaaatattaaaaaaccacccgtaaagggtggttttaattttctagataatataaaagtgttcataaataaaacagtataggtaaacaataaagtattgaaaaaagtaagtttaatatgaaaattgttaaatgaacgacatcttttgtttttataaatatcaagaaaataatcaaactcaaaataaataacgtaactgtagtcataggcgtccatacataatcagcattagtcattaagaatggtgcggccattatgaaaaaatttataatgcagatgaaatagacaattagactataaattaggtaaataacaatacacacccttcataaataaataatttaaatcctatatattttaacaaaagtaaaacacagaagtgtagaaaataaaaatattggtaaataaaatcaataagtttaaccaatatgttgctcgcttcataccgtatattgcaacaaaaattccgatcaagaaaaatatagcccctatgataaaacagaaatccgatgctgaattattaaaaaatgaggtgtttagagttagaaaatgagttaatgagttgactataactaataagatattaattatatttgtatggttcttcacatgatacctccaagtaaaaaaatctaattaataaagtgaatgcttgatgaacaagcagttattccaaacagaatcaataagaaaagtagaatcaacatgctaatgccccataaacaacccttttcactttcactattattaatttcttgacttcttttaaagatattattacttttacattctttagttgttttaaatttcacgtttttattacttccttttgtttaaaagtttacaatgaatttttgattataataatatattcaaaatagtactatctagtttgatatgtcaagcaatattattataaaattggaattctgagttgtctactctaatttattatatttacctataaaaatacacctcaaaaaatagatttttcagtctagcttttggggtgtacattccacacaaacatgtgattattttgatgtttctattaaacttgtaattttaaatttaaagtccctaaaaagtccctaaaatttttattttatatgaggtattattgataatgataaagttataaaccttgatattatgctgttttactttttgaatgataagtaattttatgttaaaagtctccagtttggatacatagaaaccttgtaacaacagtatttattgggtttggagtccctaatgggtccctaaattacatactttctaaattttagttgttttttgtcctcttcattaaatttttcttctaacaaatgagaatacacggatgtagttattgctatatttttatgacctaatcttttagaaatgtaatgtatagatacaccttttgctagtaaataagaacaatgagtgtgtcttaatgcgtgcgatgtaataattggtatattattgactctacaggctgatttcaaagcattattgatagcatgaaggttaattatagatccggcttctttgaaaatgtaaccatcatagctaattgcaaatgtacttatgacgtccataatgtgtttcatatcagatttagcgatactgatatatctaggggaagtatcggtttttcgctcgtcaataaatatagtgtttttcacttggttgatatgctcaatctttatatttcttgcaccactgacacgacaacccgtacaaatcattatgaatagcgctaatgatgaacgagttctcttctttctgacgtgatcttttagtatttcatattcagttaccgagatgaatttttcttgttctgacttcgtaggttttccggctttataattaactttataagcgggatttttaaaaataagcccatcatataatgcgtcatctaaagctgaccgaatagcaccgtttgtttttcttatagtttcttttgcgtgttcttttgaataatcgtttatgaatttctgataaacttgtctatttatctttgataactccattttacctattttatgtttttgtatatgttgtaatgcatttctataatgacggtaggtattttctttaacaacaggttgtttatacgttttaatccaattttcgaagtattcttcaagagttatatagttatctatattaaaaccacttcttaactcatttaacttgtctagtccagcagaattagcttcacgctttgttctaaaacctttcttacggtatctttttccttcatacttaaattcatattgccattttttaccatcgtaacaacgtgttttcatgcgttccctcctcaaaattggcaaaaaataataagggtaggcgggctacccatgaaaattgtataaaaaaagacgcctgtataaaatacagacgccacttatagttataagattacatggttaattaccaaaaatggtaacgaatatatacgtgttttaaaggataaacctttaatatattaaaattatatcatcttatatcaggaatctgcaatatattattattaattctatttatcagtaacataatatccgaagaatctattactggatttttaattttttggggtaaaacttttcttatgcgaaacttactaatcggctggaaagaatttatgcaagcgtaactattaccttttaatttttttaccttatcaattgctgatactatgttattaatgtttctgtcaattttatttaatttattttcaatttctaaactatcagatataaattcactaaaataatctttagtgatgaattctgtgttgtttttttggtattttttatcgaaaacttcttttaatatagctgaattattttgcgcgctaattaaatttaaaaacaatcttaaataatactcccatttcaaatcaaaattcatctttaaatactttttgttttctttagaagataagggaataacatttactatatcttccgtattagaatcatttttattcatcactattgcaaagtgtgaattagagaattctttattaacgtttataccgaaatctacaaaaactatttctccttgtttaaactttggataaaaacctttatggtttttttcaccttcaaatctcttgagtaaatagtgaatatctgaatctaattttttaaattttggatttccagaagtttttaatttattaatgcgtttttctatattatgcgtcatcatttctcctttattctcgctcacactctcaccaccattcaacgtctacacttgtagacgttttttgattagtaaaatcataatgaatcttctttggttaacttatcgccatctattttttgtgaaataaattccaagtatttacgcgcattatgtgacgataaatctttaggtaactcataagtgaatggttgattaccactagttaaaacttcatatactatagtttctttttttattttgcaattagttattttcattataaacttcctttcaaacactgctgaaatagacgtcttttatattaaagcgccacacaggcgctgttaatcacaatttagttctatcagtgattttagactccataactctttgatgtgattctttagcttctcgaatcatatctttaaattcttgactgtctataaaagctttagcctcttctatttgctcttgagtaagttctttaccaccagtattgatgtgtaagtgttcaatttctttataagtactcattttttcgactcctgttcttcaagttcacttttagttataggtaaaccattgttcaatctataagtcagttcttcttctgtataaaaggggatttcaaccatttcccactcttcaatgttaatgtcaacttctttaaaatccatgttaaaccctcctgtgaaatgaattttctattatttatagtaattacttataaaaatacaatctttacctatctcaaactttgtattctaaatgtactcgtaatccatagtctgattctttagtaacgattttctcttctaaataatctaaagttttatacttaccaccattaatatatgcgttacaagaaacgatgttgtccatatgattgactaatcttgaagcatactctctaggtacatatccaacgtgaaattcagagtattcatttgaaatcataacttttatcgcgttttcatcataaggattatccggttctttttgtaagaatacaccaggaataacctcgtaatcagaaatttcatacaccttgtcttcataaagtaattcttctttaagttcatttcctttcaaatcactatataagaaaaagaaatcgtcgttatttttcattttcttgataagtttctttaattcttttctacgaccttcataatttaatcctacgacgtcgaaaatttcaactttagtttgttcatcatcattaataggtagacaatcattcgagataattgtttccttattcttagataattgcatataagtttttaaaattgagatgaatcctgttaaaggagagtttgttacgaaataaactgttaattttctattatcgtttaatgttaaaaaagcttggtttttccaaatagtaacaacagtgttataatctatcacctctgataatgagattttgaatatataatcttcttctttccttataaaacaaatctcttcatgtgaaatgaatatagaacccattctcctcttgttttcgtcgaattttatgtcgcaactgtcgctgattattggttcaaagtaactgtattgatctgataatattttttcatcttgctttctaggtttcattttactacctcctataaaataacttttccaactaacctcacactttcgttatcataaaaatataaatctttatactttttatttaaagaaaccaacgttaatctattatcttctacataaactttctttacgtaagcatctccatttataataaagacgcctatttgtccatctttgatagtgtgagatttttcaatgaatataatttgtccgtttttaaataacggctccattgagtctccatttacttttaaagctatatcatgtgcggggacataacctcttacgaattcttttgaaataggctcgttatataatctttcgccaataccagctgacgcacaaccatatatatccacttcggatttttcttgaatgtaagaattgaaatctaccagattatcactgtcattattttgttcttctaattgattagtcgcatattttagtacattgctttgtcttggaggcgtgagtttactgtatatggaagtgatgtcgttattttcaatttttctattcttagaaatatcaaaccccataagccacgcttcgttaacgtttaaagcctttgctagttcaaagactttgtcttgtttcgcttcatattttccgtttaaataatcgctaattgagtttctaccaataccagtccttcttgatagctctgattgagatatcttccgttcagacataatttgctttaatctatccttaaaactgttcatatttctgaacacctcctaagaacataatactacgtacaatgacgattatcaataatttttaacaaatattgtacagaaaaatgtattttatgtgttgacttatttgaacaaaggtgttttaattgatttgtacagaaaaccgaacaagaagggaggtgagtttatgatatacaatttcgattatagtttgctgtacgaaagaatggcagagtatagatatagccaaagttctttagcgaacgcaatccctatttcaaggacatctattaatcacaagttgcaaggaaaaaatttatttacacaatgggaaataaaacgaatctgtgaattattagaaatcccaccaacaaaagtaggtagatatttttttgaacaaaatgtacagaaacctgtacaaatgtcgtaacaggaggaaactatggaacaaatcacattaaccaaagaagagttgaaagaaattatagcaaaagaagttagagaggctataaatggcaagaaaccaatcagttcaggttctaattttcaacaaagtaagaatcagccataacgattttgatgaaattaataaaaagtttgcttatacagaacgtttaagaggtgctgacaatctcggcttaggacatccattatctttgaagaaatatcaacacggaataggatgttatgaaaattacaaagcatacgctagtgaaattcatgaccacattagaaaacttacattatcagcttttggtgtaacgcttaattctgatttaaaagagagtgaatacgatgaagctagcagaatgtatgacatgttgaagaacttttatttatatcgttaccaaaaacgaattgaaaccttgtcaattgaagatttcgaataaaggaggaactacaaatgttacaaaaatttagaattgcgaaagaaaaaaataaattaaaactcaaattactcaagcatgctagttactgtttagaaagaaacaacaaccctgaactgttgcgagcagttgcagagttgttgaaaaaggttagctaaattcaacggtaaggatttgccctgcctccacacttagagtttgagatccaacaaacacataagttttagtagggtctagaaaaaatgtttcgatttcctcttttgtaacagtttcaattccttcatatcctggaaaaacaattttctttaaatccgaaacatgtttttttgaaccatcctttaaagtaactagaagtttcatacttatcacctccttaggttgataacaacattatacacgaaaggagcataaacaatatgcaagcattacaaacaaaatcgaacataggagaaatgttcaatattcaagaaaaagaaaatggagaaatcgcaataagtgcaagagagttatataaagctttggaagttaaaaagcgttttagcgcttgggcagaaattaacttgaagcatttcaaagaaaatagggattttacaagtgtacttacaagtacggttgttaataacggagctgtaagacaactagaagattatgctttaacacttgatgtagctaaacatgttgcaatgatgtcaggtacagaaaaaggttttgattttagagagtacttcatccaagttgaaaaagcatggaatagcccagaaatgattatgcaacgtgctttaaaaattgctaacaacacaatcaatcaattagaaacaaagattgaacgtgataaaccaaaaattgtatttgcagatgcagtagctactactaagacatcaattttagttggagagttagcaaagatcattaaacaaaacggtgtaaacatcgggcaacgcagattgtttgagtggttacgtcaaaacggattccttattaaacgcaagggtgtggattataacatgcctacacagtattcaatggaacgtgagttattcgaaattaaagaaacatcaatcacacattcggacggtcacacatcaattagtaagacgccaaaagtaacaggcaaaggacaacaatactttgttaataagtttttaggagaaaaacaaacatcttaataggagaacactatggaacaaatcacattaaccaaagaagagtgtgtcgaacaatgcatcaataaagacttaaaacttttagattatcgagttcaacaaattttagaaggtgttctatcagaaagtaccacatacggtgatgcaagaaataaattagaaacattgaaaattattgctgaatctcattttaaaaccgaacatgcttcagttatttacaaattagcattgaaaaagttagacaaaaaaatcaacgccactccaattaaagagtgacgaaaaaggaggatttcaaatgtttaagattttaaatgatataaaaacttctttaaaaaaccatccttggggttggaaagagcacttaccttatttactgatgttaactctgtcacttgtggctctgattttcggtgttctgtccgcgattctatgataacaggttttatatagattccttacctcctctctgtaggagataacaatattatacacgaaaggaatgatagaaatgccacatgtattaaacgtaaccgttccaatacctgaaacacacgtgcttatcacaaaagatgaatatgaagagttaatagcttactcattagaccctgtatggaacatgagcgacttaaagaagaaattaaaaattgcatctgatgagactatcaaggacagattactatttcatcctagatttgaaaaagaactaagagcgcaaggaattgtgcattacccagatgagaattttaatcgctggagatttaacgcaagaaagatgaataaattcgtcgatgagcatttcaatgaaatatataaggagagaataaaatgagtaaaacttataaaagctacttattagcagtattatgcttcacagtcttggcaattgtacttatgccgtttctatacttcactactgcatggtcgattgcgggattcgcaagtattgcaactttcatattctataaagaatacttttatgaagaataaaaaaactgctacttgcgccaacaagtaacagtgacaaacgattaacaaaattaattcatgttcaatataaaacgaaataaaggaagtgtcaacaatgtactacaaaattggcgatgtatgtcaaaaagtaattaatgtagacggattcgattttaaattagcagttaagaaacaagattacagcattctagtgaatgtcttagatttagaagatagatttatcgacagtataaatataacagatgagaatgatctatacacagcattagacatattaaatcaatctatttatgaatggattgaagagaacacagacgaaagagacaggctaattaacttagtcatgagatggtaggtataagcatgagagatacagaaagaaatatattgaatatttttaaaacgttattcgacgaatatactttgtcaaaccaacgagcattattggaaattgaacgtaatcatcacggatacttatcgattaatttcttgcactatcacgacagttacaaaacgaacaataagcttgtacagatacatgaaatcaatccggacagccacgaacgaataaaaaatttaattatcgaggtgctaagaggtcatcggaagattaaaaaaggagcatgaggatggaaataaaaataaataagttaactatatcaaactttgctggaatcaaagaagaaagctttaactttaacggcaaagatgcaaaaatatacggcaataatgcaacgggtaagactacgacagcaaccgcattacaatggctgcttttcgataaaggtttggacggatcaaccaaatcatttaaccctgtacctttaaacgaaaaaaacgaagaaaattatgagttaattccgactgttttcgcagaatttgaaatcgacggaaaaattacgacttttaaaaaagagtcacatcctaaatacacaataaatcaaaaaacgaatcgcaaggaatactcacgaagtcgaacgaagaaacaatatatcaatgatgaatcaataaaagtaaaggattataaagctcgtattgatgaactgattgatgaagatgtattcaagttaattacgaaccctcaagcatttaacttactagattggaagaaacgaagaagtttgttgtttgaaatcgctaaaccaatcaatgatgaggatgtcattaaaacaaatgatgattttaaagaactaaataatattcttggagatcacgaaattgaaacaaagaaaaagattcttacagacaagataaaacagattaacaaagatatcaaagacattccgatacgtattaaccaaacacaacaaaataagcaggatgtacctgaattcgataatgatagatacgcaattatcaaacaagaaattgagcaacttgaaaatgagcgtatagatattcaaaacggtaaggaagaaattaatttgcgtaatcaattagctgataaacaatcagaattgaaacgcatagaagacaataacagcgcaagtaatgagaacaaaatccatgctttaacaaatgagctacacgttgaaaatggaacggttgcgaatcttaaaacaagattaaagcaaaacaaacaacaaattacacatgaagaaaatcgacgtaatcaattattagaaaatcataaaggattaaaaagtgatttagaaaaagctaaaaatcaaaaatttgaatatcttgatgacaatgtatgtagttgttgtggtcaacagttaccagctgaacaagtgagtgaggtaagagaaaaagcattgcagaaattcaatgcaaacaaatcgaaagaattagaaacaatacaaacatctatcaatcacattatttcagagggcaagaaaataaagccaattatcgagaaattagaggatgacaacaataatttacaaattaaaatcaacgaagcagaagagcgttcagcaagaatacaaaacaaaattaataagttgaaaacaactcacgttgacgttacgcaaactgacgaatacaaagcagtaatgttagagataaatgagattaatcaaaaacgctctaacatcaggaaaactattcaagataaagtttcaggaatagatgacaaaataagcgaacttactcaagaaaaatcagaaattgaagtgtcaatatcaatcgaaaaatcaaataaacatctagatgatgttatttctgaattaagaaatgaagaagacagattattggatgaaaaagaaaagtattcacatgacctttatatcttaaaagaatttacaacaacaaaagtcaaaatgcttactgaaaacatcaataacgaatttgatattgctgaatttaagctattcaataccttagttaacggcgaattagaagaaacatgttcaacaacggttaatggtgtcgagtatgacagcggtttaaataacgcctcaagaattaatgttggcttagatatcatcaacacactatcaaaacattttaaagttacagcgccaatatttattgataatgctgaatcagtaacagagcttatcaaaacagaatcacaacaaattcaattgatagtaaatgaacaagataaaaaattaagaatggagactatataaaatgactgaaaataataaattacaaactattgaacaacaattagtacaagaaaagaacgtatctgacaacgtattaaacaaagtgagagttttagagtcacaaggcaatttggaattgccaaatgattattcaccaagtaatgccatgaaacaagcatggttacaaatcagccaagataacaaattaatgagttgtaacgatacaagcaaagcaaatgccttattagacatggtaacgcaaggtttaaatccagctaaaaatcaatgctactttattccttacggcaacaaaatgcagttacaacgtagctatcacggtaatgtaatgatgttaaaacgtgatgcaggtgctcaagatgttgttgctcaagtgatttataaaggcgatacattcaagcaagaaatgggagaaacaggacgtatcaaagcgattaaacacgaacaagacttctttaacatcgacaaagaaaacattatcggtgcgtactgcacaatcgtatttaatgatggacgagataactatattgaagtcatgactattgaacaaattaaacaagcatggatgcagtcatcaatgattaaagatgaaaaagcattacaaaattctaaaacacataataatttcaaagaagaaatggctaaaaaaacagttatcaatagagctgctaaacgttatatcaacacatcaacagatagcaatcttttcaaatacgcacaagaatccgaacaacgtcaacgcaaagaagtgttggacgcagaagttgaagaaaatgcaaatcaagaacaattggactttgaacaaccagttcttgaagaagcacaatacacagaattagaaaatgataagcctattgatgtatctgactttgaagaaataaaagaacctgcaacagaaaaagaaagcgaagaagagccattttaattgaaacaatagcaactggttcaagtggtaactgctacgtcttaaatgatggacgtactacgttactatttgaggcaggtataaaatttgaacgtgttcaaaagcatttcaaatataaaacaagacatatagcagggtgtcttatcacacacgaacatggtgatcatgcaaagtacacaaagcagtttgtcgacaatggtgtaataagctatatgactgctggaacacaacaagctatgtaatttgaaagtcatcgcttatgcacgattaaggcaaagcaagagctgcgaataggtacatggtcaattctaccgtttgacatcgaacatgatgctaacgagcctgtggctttcttattacaaagcacactaggttataaggttctgtatgttactgatacaaagtatttgaaatacaaatttaatggcattacgcacatgatgctagaagttaattatatctatgaacaaatgcaagaaaacataaaaaacggcagtgtgcacagcacattagcaaacagaattatggagtctcattttagcttagaacatgctatcggaatgttaaaagcaaatgatttaactagactcgaagaaatacatttaattcatttaagtagtcaaaattcaaatgcaaaatacattaaaagtgaaatacaaaaagtgacgggcgcgcccgtttattttggaggtttataaatgctaaacagaacaatattagttggtcgtttaactagagacccagaattaagaaccactcaaagtggtgtaaatgtagcatcattcacattagcagttaaccgtacatttacaaatgcacaaggcgagcgcgaggcagactttattaatatcatcgtatttaaaaaacaagcagagaacgttaataaatacctatctaaaggatcgttggcgggcgtagatggtaggttacaaacgcggaactatgaaaataaggaaggtcaacgtgtatacgttacggaagttattgctgatagtattcaatttttagaaccgaaaaactcaaatgacactcaacaagatttatatcaacaacaagtacaacaaacacgtggacaatcgcaatattcaaataacaaaccagtaaaagataatccgtttgcgaatgcaaatggtccgattgaactaaatgatgatgatttaccattctaatttaaccggtttgaaagtgaggtgtgtatatgactggttggataagtattgatcgctcaattcaaaatcattggctatttaaagaaaagagaacattttcaaagttcgaagcatggatatatttactcatggaagcgaatcattcagaggcaaaagtgcctataggaaaccaaattgtaaccgttgaaagaggacaaagattaacatctattttgaccttgtctgacctttttaactggtcacgatttaaagtgaaaaccttccttgacttactcgagagtgatggaatgttagaagtcaaaacaacatcaaaatatacccttataaccattgtcaattatgacttttatcaaagtgagcagggcaggaaccaacatcaaaacgacatcaaaccaacatcaaaacaacatcagtcaaacatcaacccaacatcaaaacaacatcaaaccaacacaaacaataatgataataaagataataatgaaaagaatgtgaataatgagaagaagaaggtaaccgccttcgacttcttccaagataacggattcggtttcataactccttacaatttagacgatttaaattactatcttgattcatttgaaaatgattcagatgaaatagttaccgcatcacttaaaatcgctaaagacagaaacaaggttacttggggatatgctaaaagcattttgaatacttggcttaatgcaaacttgaaatctattgaacaagtacgtgcatttgaaaagcaacaacttgaaagcaaaaaacaaaattataaacctttcgttaaacaatcaaaagaaaaaacacccaaatggctcacagacagcacgagagaaacgaaaacgccggaagtagatgaaaaccttgagaaagacagagaagcttttattaagcgtctaaatagcaaatgggagtgattgaaaatggatgcatttgataaatactatctatttgatcatgacggcaacaaaatgttttcagttacaccacattttaaagatggacggcatttagttgttggattaaaacatacaaaattcaatggtcgacgttggtacttagatgattatgaattaaaaacacttattgataatgaacaaatggagttaggacaccaaacaagcttatttgaatatatatgagggattacatggagatagaaattaaatttaacgaaactttcgaggcacctatgggctcgcctcgaccgcgttttagcacaaaaggtagatatgcacacatatatgcctacaaaatatacagaacataaaaaatatttacaaaatcaaatgccaaagctaaatctagaaaatgcattaaaaattgaattagagttttactttactccacctaaatcatggtcgaagaaaaagaaaactcaagcgattggacaattaaaagtaactaaaccagatatcgataatttgatgaagacagttctagacgcttgtaacaattatttgtggaaagatgacaatcaaattgcagaaataactagctcaaagcgttatggaattgagcccaaaataatcatacgaatagaagaaatataagaggtggataaaatggcgagaaaagcaaggattgtaacaataaatgataaaccatataggtttaccaaatctgaaatggaattaatagaaagtcacggtataaccgctggaatggtttctaagagagtaaaagacggttgggaactacatgaagcaatggacgcaccagaaggtacgcgtttaagcgagtacagagaaaagaaaacaatagaaagactggaacaagctagactcgaacgcaaattggaaagaaagcgaaagaaagaggctgagctaagaagaaagaagccacatttgtttaatgtgcctcagaaacatccaagaggacgttatgcgtgctacctgatggaaaacgacatattcgtgaaagttaagaagtagatcatgacagataacgcacgcaaagaatacctaaatcaattctttggatctaagagatatctgtatcaagataacgaacgagtggcacatatccatgtagcaaacggcaattattactttcacgggcatatcgtaccaggttggcaaggcgtaaagaagacgtttgatacagccgaagagctagaaatatatataaagcaacatggtttggaatacgagaaacagaagcaactaactttattttagtaggagatggaaatgatgaataaccgctataagtgctagtgcgtataacggtaatgacacagagggattactaaaagagattgaggacgtatataagaaagcgcaagcgtttgatgaaatacttaagggtttacctaatgctatgcaagatgcactcaaagaagatattggtcttgatgaggcagtagggattatgacgggtcaagtggtctataaatatgaggaggcacaggaaaatgaataacacattaacaattgatcaattacaagagttattacaaatacaaaaggagttcgacgatagaataccaacgctgaacttacgagatagcaaaatagcatatgtagttgaattctttgaatggtttaatacattggaaacgtttaagaactggaagaagaaaccaggtaagccgttagacgtacaacttgatgaattagctgacatgttggcgtttggattgagtattgcgaatcaagtaggagtgtcatcagaagagataaaagaagcgattgaatcaagttttaaagatacagaatttcacaaaatgtttaattttaaagataaagaatttgctcaagacgcagttgttagtacaccacagataatattcaaagaattttatcccgaccaacaagcaattgttatagtgatagacatagcttacaacttatattctatcgaccaactcattgacgcatacaaaaagaaaatgaaaaggaaccacgaaagacaagatggaacagcagacgcaggaaaaggatacgtgtaaagacatcttagatcgagtcaaggaggttttggggaagtgagcgacatgttagaaatatttttaatagggtttggcgtttatctcttttatcgcatagcaattatttttcttaagagtaaaaagactatacacacaaacatatatgaaatgttaatgcttgctactatctttatgatatctacatttgcttataaacatcaaaagacgcatatcttaatagcatttttagtaatgttttttatgagtaagctcaaacaagttcaagggagctatgaggaatgacacaatacttagtcacaacattcaaagattcaacaggacgtaaacatacacacataactaaagctaagagtaatcaaaggtttacagttgttgaggcagagagtaaagaagaagcgaaagagaagtacgagaaacaagttaaaagggatgcagttattaaagtgggtcagttgtttgaaaatataagggagtgtgggaaatgattaaaaaacttaaaaatatggatgggttcgacatctttattgttggaatactgtcattattcggtataaccgcattgctacttgttgtcgcattgcctatctatacagtggctagttaccaaaacaaagaagtacatcaagggacaattacagataaatataacaaaagacaagataaagaggacaaattctatattgtattagatgataaacaagtcatcgaaaactcagacttattcttcaaaggaaagtttgatagcgcagacatacaagctaggttaaaagtaggtgataaagtaaaagttaagacgattggatatagaatacactttttaaatttatatccggtcttatacgaagtaaagaaggtagataaaaaatgattaagcaaatactaagattattattcttactagcgatgtatgagttaggtaagtatgtaactgagcaagtatatattatgatgacggctaatgatgatgtagaggcgccgagtgattacgtctttcgagcggaggtaagtgagtgatgtggattactatgactattgtatttgctatattgctattagtttgtatcagtattaatagtgatcgtgcaagggagatacaagcgctcagatatatgaatgattatctacttgatgaagtagttaaaactaaaggatacaacgggttaaaagaatacaggattgaattaaagcgaatgaataacgatattaaaaagtaatttatattatcggaggtattgcattgaatgataaagattgagaaacacgatatcaaaaagcttgaagaatacattcagcacatcgataactatcgaagagagttgaagatgcgagaatatgaattacttgaaagtcatgaaccagataatgcgggagctggcaaaagtaatttgccgggtaacccgattgaacgatgtgcaataaagaagtttagtgataacaggtacaatacattaagaaatatagttaacggtgtagatagattgatagatgaaagtgatgaggatacgcttgagttattaaggtttagatattgggattgtcctattggttgttatgaatgggaagatatagcacattactttggtacaagtaagacaagtatattacgtagaaggaatgcactgatcgataagttagcaaagtatattggttatgtgtagcggacttttaccctatgtaagtccgcattaaaacagtttattatgttagtatcagattaatatttaaagttattaaatgctaatacgacgcatgaacaagaggcgcatcactatgtgatgtgtctttttatttatgaggtatgaacatgttcaaactaatagtaaatacattactacacatcaagtatagatgagtcttgatactacttaagttatataaggtgaaacattatgatgactaaagacgaacgcatacgattctataagtctaaagaatggcaaacaacaagaaaaagagtgctagaaagagataattatgaatgtcaacaatgtaagagagacggcaagttaacgacatatgacaaaagcaagcgtaagtcgttggatgtagatcatatattatcgctagaacatcatccggagtttgctcatgacttaaacaatttagaaacactgtgtattaaatgtcacaacaaaaaagaaaagagatttataaaaaaagaaaataaatggaaagacgaaaaatggtaaatacccccgggtcaaaaaaatcaaaagcgatcaaaatacttgggg

SEQ ID NO: 7 - DNA, 42325 bp, Unknown
  Description of Unknown: Undetermined Bacteriophage F91a/06 polynucleotide
accccccctcttataaccattttaaggcaggtgatgaaatggagattatagtcgatgaaaatttagtgcttaaagaaaaagaaaggctacaagtattatataaagacatacctagcaataaattaaaagtagttgatggtttaattattcaagcagcaaggctacgtgtaatgcttgattacatgtgggaagacataaaagaaaaaggtgattatgatttatttactcaatctgaaaaggcgccaccatatgaaagggaaagaccagtagccaaactatttaatgctagagatgctgcatatcaaaaaataatcaaacaattatcggatttattgcccgaagagaaagaagacacagaaacgccatctgatgattacctatgattagtaataaatacgttgatgaatatataaatttgtggaaacaaggaaagataattttaaataaagaaagaattgatctctttaattatctacaaacaacatatatattcacgagatgatgtatattttgatgaacagaaaatcgaggattgtatcaaatttattgaaaaatggtattttccaacattaccatttcaaaggtttatcatagctaatatatttcttatagataaaaatacagatgaagctttctttacagaatttgctattttcatgggacgtggaggcgggaaaaacggtctaataagtgctattagtgattttctttctacgcccttacacggagttaaagaatatcacatctccattgttgctaatagtgaagatcaagcaaaaacatcgtttgatgaaatcagaaccgttttaatggataacaaacgaaataagacgggtaaaacgccaaaagctccttatgaagttagtaaaacagaaataataaaccgtgcaactaaatcggttattcgatataacacatcaaacacaaaaaccaaagacggtggacgtgaggggtgtgttatttttgatgaaattcattatttctttggtcctgaaatggtaaacgtcaaacgtggtggattaggtaaaaagaaaaatagaagaacgttttatataagtactgatggttttgttagagagggttatatcgatgcaatgaagcacaaaattgcaagtgtattaagtggcaaggttaaaaatagtagattgtttgctttttattgtaaattagacgatccaaaagaagttgatgacagacagacgtgggaaaaggcgaacccaatgttacataaaccgttatcagaatacgctaaaacactgctaagcacgattgaagaagaatataacgatttaccattcaaccgttcaaataagcccgaattcatgactaagcgaatgaatttgcctgaagttgaccttgaaaaagtaatagcaccatggaaagaaatactagcgactaatagagagataccaaatttagataatcaaatgtgtattggtggtttagactttgcaaacattcgagattttgcaagtgtagggctattattccgaaaaaacgatgattacatttggttaggacattcgtttgtaagacaagggtttttggatgatgtcaaattagaacctcctattaaagaatgggaaaaaatgggattattgaccattgtcgatgatgatgtcattgaaattgaatatatagttgattggtttttaaaagctagagaaaaatatgggcttgaaaaagtcatagctgataattatagaactgatattgtaagacgtgcgtttgaggatgctggtataaaacttgaagtacttagaaatccaaaagcaatacatggattacttgcaccacgtatcgatacaatgtttgcgaaacataacgtaatatatggagacaatcctttgatgcgttggtttactaataatgttgctgtaaaaatcaagccggatggaaataaagagtatatcaaaaaagatgaagtcagacgtaaaacggatggatttatggcatttgttcatgcgttatatagagcggatgatatagtagacaaagacatgtctaaagcacttgatgcattaatgagtatagatttctaatagaggaggtgagacatgagtattctagaaaagatatttaaaactaggaaagatatatcatatatgcttgatttagatatgatagaagatttatcacaacaagcgtatgtgaaacgtttagcgattgatagttgtattgaatttgttgcgcgagctgtcgctcaaagtcattttaaagtattggaaggtaatagaattcaaaagaatgatgtttactacaagttaaatataaaaccaaatactgacttatcaagcgatagtttttggcaacaagttatatataaactaatttacgataacgaggttttaatcgtagtaagtgacagcaaagaattacttatcgcagatagcttttacagagaagagtatgctttgtatgatgatatattcaaagatgtaacggttaaagattatacttatcaacgtactttcacaatgcaagaggtcatattatttaaagtacaacaacaataaagtgacacactttgtagaaagtctattcgaagattacgggaaaatattcggaagaatgataggtgcacaattaaaaaactatcaaataagagggattttgaaatctgcctctagcgcatatgacgaaaagaatatagaaaaattacaagcgttcacaaataaattattcaatacttttaataaaaaccaactagcaatcgcgcctttgatagaaggttttgattatgaggaattatctaatggtggtaagaatagtaacatgcctttttctgaattgagtgagctaatgagagatgcaataaaaaatgttgcgttgatgattggtatacccccaggtttgatttacggagaaacagctgatttggaaaaaaaacacgcttgtatttgagaagttctgtttaacacctttattaaaaaagattcagaacgaattaaacgcgaaactcataactcaaagcatgtatttgaaagatacaagaatagaaattgtcggtgtgaataaaaaagacccacttcaatatgctgaagcaattgacaaacttgtaagttctggttcatttacaaggaatgaggtgcggattatgttaggtgaagaaccgtctgacaatcctgaattagacgaatatctagtgacgaagaactacgaaaaagcaaacgaaaatggtagtacattgaaaggtggtgatgaagatgaaagtggagattaaaggcgtcatcgtttccaacgaagataaatgggtttacgaaatgcttggtatggattcgacttgtcctaaagatgttttaacacaactagaatttagtgatgaagatgttgatattataattaactcaaatggtggtaacctagtagctggtagtgaaatatatacacatttaagagctcataaaggcaaagtgaatgttcgtatcacagcaatagcagcaagtgcggcatcgcttatcgcaatggctggtgaccacatcgaaatgagtccggttgctagaatgatgattcacaatccttcaagtattgcgcaaggagaagcgaaagatctaaatcatgctgcagaaacattagaacatgttggtcaaataatggctgaggcatatgcggttagagctggtaaaaacaaacaagaacttatagaaatgatggctaaggaaacatggctaaatgctgatgaagccattgaacaaggttttgcggatagtaaaatgtttgaaaacgacaatatgcaaattgtagcaagcgatacacaagtgttatcgaaagatgtattaaatcgtgtaacagctttggtaagtaaaacgccagaggttaacattgatattgacgcaatagcaaataaagtaattgaaaaaataaatatgaaagaaaaggaatcagaaatcgatgttgcagatagtaaattatcagcaaatggattttcaagattccttttttaatacaaaaataggaggtcataaaatgactataaatttatcggaaacattcgcaaatgcgaaaaacgaatttattaatgcagtaaacaacggtgaaccgcaagaaagacaaaatgaattgtacggtgacatgattaaccaactatttgaagaaactaaattacaagcaaaagcagaagctgaaagagtttctagtttacctaaatcagcacaaactttgagtgcaaaccaaagaaatttctttatggatatcaataagagtgttggatataaagaagaaaaacttttaccagaagaaacaattgatagaatcttcgaagatttaacaacgaatcatccattattagctgacttaggtattaaaaatgctggtttgcgtttgaagttcttaaaatccgaaacttctggcgtggctgtttggggtaaaatctatggtgaaattaaaggtcaattagatgctgcgttcagtgaagaaacagcaattcaaaataaattgacagcgtttgttgttttaaccaaaagatttaaatgattttggtcctgcgtggattgaaagatttgttcgtgttcaaatcgaagaagcatttgcagtggcgcttgaaactgcgttcttaaaaggtactggtaaagaccaaccaatcggcttaaaccgtcaagtacaaaaaggtgtatcggtaactgagggtgcttatccagagaaagaagaacaaggtacgcttacatttgctaatccgcgcgctacggttaatgaattgacgcaagtgtttaaataccactcaactaacgagaaaggtaaatcagtagcggttaaaggtaatgtaacaatggttgttaatccgtccgatgcttttgaggttcaagcacagtatacacatttaaatgcaaatggcgtatatgttactgctttaccatttaatttgaatgttatcgagtctacagtccaagaagcaggtaaggttttaacgtacgttaaaggtttatatgatggttatttagctggtggtattaatgttcagaaatttaaagaaacacttgcgttagatgatatggatttatacactgcaaaacaatttgcttacggcaaagcgaaagataataaagttgctgctgtttggaaattagatttaaaaggacataagccagctttagaaggtaccgaagaaacactataaaattttatgaggtgataaaatggtgaaatttaaagttgttagagcttttaaagacatagagcacaatcaacacaagtacaaagtaggggagttgtatccagctgaagggtataacaatcctcgtgttgaattgttgacaaatcaaatcaaaaataagtacgacaaagtttatatcgtacctttagataagctgacaaaacaagaattattagaactatgcgaatcattacaaaaaaaagacgtctagttcaatggttaaaagtgaaatcgtcgacttattgaatggtgaagacaatgacgattgatgatttgcttgtcaaatttaaatcacttgaaaagattgaccataattcagaggatgagtacttaaagcagttgttaaaaatgtcgtacgagcgtataaaaaatcagtgcggagtttttgaattagagaatttaataggtcaagaattgatacttatacgcgctagatatgcttatcaagatttattagaacacttcaacgataattacagacctgaaataatagatttttcgttatctctaatggaggtatcagaagatgaagaaagtgtttaaaaaacctagaattacaactaaacgtttaaatactcgtgttcatttttataagtatactgaaaataatggtccagaagctggagaaaaagaagaaaaattattatatagctgttgggcgagtattgatggtgtctggttacgtgaattagaacaagctatctcaaacggaacccaaaatgacattaaattgtatattcgtgatccgcaaggtgattatttacccagtgaagaacattatcttgaaattgaatcaagatatttcaaaaatcgtttgaatataaagcaagtatcaccagatttggataataaagactttattatgattcgtggaggatatagttcatgagtgtgaaagtgataggtgataaagcattagaaagagaattagaaaaacgttttggcataaaagagatggtaaaagttcaagataaggcgttaatagctggtgctaaggtaattgttgaagaagtaaaaaaacaactaaagccctcaaaagatacgggagcattaattaatgaggtaagttttagtaaacctgaatggataaacggaaaacgtacaattactgttcattggcgaggttctaaagaccgttataaaatcgtacatttaattgaatatggacacgttcaaaaaggaacaggtaaatttatcaaacctaaagctatgggcggtgttaatagagcaataagacaaggtcaaaataagtattttgaaacgttaaaaagggagttgaaaaaattgtgattgatattttgtacaaagttcatgaagtgattagtcaagacagaattattagagagcacgtaaatatcaataatattaagttcaataaataccctaatgtaaaagatactgatgtaccttttattgttattgacgatatcgacgacccaatacctacaacttatactgacggagatgagtgtgcatatagttatattgtccaaatagatgtttttgttaagtacaatgatgaatataatgcgagaatcataagaaataagatatctaatcgcattcaaaagttattatggtctgaactaaaaatgggaaatgtttcaaatggaaaaccggaatatatagaagaatttaaaacatatagaagctctcgcgtttacgagggcattttttataaggaggaaaattaaatggcaataaaacatgcaagtgcgccaaaggcgtattttaacattactggtttaggtttcgctaaattaacgaaagaaggcgcggaattaaaatatagtgatattacaaaaacaagaggattacaaaaaattggtgttgaaactggtggagaactaaaaacagcttatgctgatggcggtccaattgaatcagggaatacagacggagaaggtaaaatctcattacaaatgcatgcgttccctaaagagattcgcaaaattgttttttaatgaagattatgatgaagatggcgtttacgaagagaaacaaggtaaacaaaacaattacgtagctgtatggttcagacaagagcgtagagacggtacatttagaacagtttattacctaaagttatgtttacaaatcctaaaatcgatggagaaacggctgagaaagattgggatttctcaagtgaagaggttgaaggtgaggcacttttccctttagttgataataaaaagtcagtacgtaagtatatctttgattcagctaacatgacaaatcatgatggagacggtgaaaaaggcgaagaggctttcttaaagaaaattttaggcgaagaatatactggaaacgtgacagagggtaacgaagaaactttgtaacaaaaccggcttcatcggaaactgcggtaaagtcggttaatataccagatagcattaaaacacttaaagttggcgacacatacgatttaaatgttgtagtagagccatctaatcaaagtaagttattgaaatacacaacagatcaaacgaatattgtatcaatcaatagtgatggtcaagttactgcggaagcacaaggcattgctacggttaaagcaacagttggtaatatgagtgacactataacaataaatgtagaagcataagagggggcaacccctctattttatttgaaaataaggagagtattataaaatggcaaaattaaaacgtaacattattcaattagtagaagacccgaaagcaaatgaaattaaattacaaacgtacttaacaccacacttcatttcatttgaaattgtatacgaagcaatggatttaatcgatgatattgaggacgaaaatagcacgatgaaaccaagagaaatcgctgacagattgatggatatggttgtaaaaatttacgataaccaattcacagttaaagacctaaaagaacgtatgcatgcacctgatggaatgaatgcacttcgtgaacaagtgattttcattactcaaggtcagcaaactgaggaaactagaaattttatccagaacatgaaataaagcctgaagatttaacatataaagcaatgttgaaaaatatggatactctcatgatggacttaattgaaaatggtaaagacgctaacgaagttttaaaaatgccatttcattatgtactttccatatatcaaaataaaaacaatgacatttcttgaagaaaaagcagaggctttaattgatgcgttttaaccttaaccgtttggttagggttatttttttgaacttttttagaaaggaggtaaaaaatgggagaaagaataaaaggtttatctataggtttggatttagatgcagcaaatttaaatagatcatttgcagaaatcaaacgaaactttaaaactttaaattctgacttaaagttaaccggtaacaacttcaaatataccgaaaaatcaactcatagttacaaacaaaggattaaagaacttgatggaactatcacaggttataagaaaaacgttgatgatttagccaagcaatatggcaaggtatctcaagaacagggcgaaaacagcgcggaagctcaaaaattacgacaagaatataacaaacaagcaaatgagctgaattttttagaaaaagaactagaaaaaacaacaactgagtttgaagagttcaaaaaagctcaagttgaagctcaaagaatggcagaaagtggctggggaaaaaccagtaaagtttttgaaagtatgggacctaaattaacaaaaatgggtgatggtttaaaatccattggtaaaggtttgatgattggtgtaactgcacctgttttaggtattgcagcagcatcaggaaaagcttttgcagaagttgataaaggtttagatacagttacccaagcaacaggagcaaccggcggagagcttaagaagttgcagaattcatttaaagatgtttatggcaactttccagaagacgctgagactgtaggcggtgttttaggggaagttaacacaaggttaggtttcactggcaaagaacttgagagtgccacagagtcattcttgaaatttagtcacataacaggttctgacggcgtacaagccgttcaattaattacgcgtgcaatgggtgatgcaggtattgaagctgatgagtatcaaagtgtacttgatatggtagcgaaagcagcacaggctagcggtataagtgttgatacattagctgatagcattactaaatacggtgctccaatgagggctatgggctttgagatgaaagaatcaatcgctttattctctcaatgggagaaatcaggtgttaatactgaaatagccttcagtggtttgaaaaaagctatatccaattggggtaaagcgggtaaagacccaagagaagaatttaagaagacattagcagaaattgaaaggacaccggatatagctagcgcaacaagtttagcgattgaagcatttggtgcaaaagcaggtcctgatttagcagatgctattaaaggcggtcgctttagttaccaagagttcttaaaaactatcgaagattcgcaaggaacggtcaatcagacatttaaagattctgaaagtggctccgaaagatttaaagtagcaatgaataaacttaaattagtaggtgctgatgtatgggcttctattgaaagtgcgtttgctccagtcatggaagaattaatcaaaaagctatctgtagcagttgattggttttcaagtttaagtgatggatctaaaaggtcgattgttatattcggtggtattgctgctgcaattggtcctgtagtttttggattaggtgcattcataagcacagttggcaacgcagtaactgtattagctccattattagctagtattgcaaaggctgacggattgattagttttttatcaactaaagtgcctattttaggaacagtcttcacagcattaactggtccaattggtatcgtgttaggtgtactggctggtttagcagtcgcatttacaatagcttataagaaatctgaaacattcagaaattttgttaatggtgcaattaacagtgttaaacaaacgtttagtaatttcattcaatttatccaacctttcattgattccgttaaaaacgtctttaaacaagcggtttcagcaatcgttgatttcgctaaagatatttggagtcaaattaatggattctttaatgaaaacggaatttctattgttcaagcgcttcaaaatatatgcaattttatcaaagctatatttgaatttatcttaaattttgtaattaaaccaatcatgtttgcgatttggcaagtgatgcaatttatttggccggcggttaaagccttgattgtcagtacttgggagaatataaaaggagtaatacaaggtgctttaaatatcatacttggctttatcaagttcttttcaagtttattcactggtaattggcgaggtgtttgggacggtattgtgatgatactaaaaggcactgtgcagttaatttggaatttaatacaactgtggtttgtaggtaagattctaggtgttgttagatactttggtggattgcttaaaggtttaatatccggtatctggggtgttatcaaaggtattttcacaaaatcattatctgcaatttggaatgcaacgaaaagtattttcggtttcttatacaatagtgttaaatctattttcactaatatgaaaaactggttatctagtacgtggaataatatcaaaagcaataccgtcggcaaggctcattcgttatttacgggtgtaaggtctaaattcacaagtttatggaatgcgacgaaagatatatttactaagttaagaaattggatgtcaaacatctggaactctattaaagataacacggtaggtatagctggtcgtttgtggataaagtacgtaatatcttcggaaacatgcgtgacggtttaaaatctatcattggtaaaattaaagatcatatcggcggtatggtagatgctattaaaaaaggacttaataaattaattgaaggcttaaactgggtcggtggtaagttaggtatggatgaaatacctaggttacacactggtacagagcacacacatactactacaagattagttaagaacggtaagattgcacgtgatacattcgctacagttggggataaaggacgtggaaatgcccttaatggttttagaaatgaaatgattgaattccctaatggtatacgtgtaatcacacctaatacagacactactgcttatttacctaaaggctcaaaagtatacaacggtgcacaaacttattcaatgttaaacggaacgcttccgagatttcatttcggtactactatgtggaaagatattaaatctagtgcatcatcggcatttaactggacaaaagatcaaataggtaaaggtaccaaatggcttggcgataaagttggcgatgttttagattttatggaaaatccaggcaaacttttaaattatatacttgaagcttttggaattgatttcaattctttaactaaaggtatgggaattgcaggcgacataacaaaagctgcatggtctaagattaagaaaagtgctactgattggataaaagaaaatttagaagctatgggcggtggcgatttagtcggtggaatattagaccctgacaaaattaattatcattatggacgtaccgcagcttataccgctgcaactggaagaccatttcatgaaggtgtcgattttccatttgtatatcaagaagttagaacgccgatgggtggcagacttacaagaatgccatttatgtctggtggttatggtaattatgtaaaaattactagtggagttatcgatatgctatttgcgcatttgaaaaactttagcaaatcaccacctagtggcacgatggtaaagcccggtgatgttgttggtttaactggtaataccggatttagtacaggaccacatttacattttgaaatgaggagaaatggacgacattttgaccctgaaccatatttaaggaatgctaagaaaaaaggtaggttatcaattggtggcggtggcgctacttctggaagtggtgcaacttatgccagccgagtaatccgacaagcacaaagtattttaggaggacgttataaaggtaagtggattcatgaccagatgatgcgagttgcaaagcgcgaaagtaactatcaatcaaatgcagtgaataattgggacattaatgctcaaagaggagacccgtctagaggattattccaaattatcggctcaacttttagagctaacgctaaacgagggtacactaattataataatccagtacatcaaggtatctcagcaatgcagtacattgttagacgatatggttggggtggttttaaacgtgctggtgattacgcatatgctacaggtggaaaagtttttgatggttggtataacttaggtgaagacggtcatccagaatggattattccaacagatccagctcgtaaaaaatgatgcaatgaagatgttgcattatgcagcagcagaagtaagagggagaaagcgagtaaaataagcgtcctagtcaattgtctaatgtaaatgggtttgatgacccaagcttattattgaaaatgattgaacaacagcaacaacaaatagctttattactgaagatagcgcaatctaacgatgtgattgcagataaagattatcagccgattattgacgaatacgcttttgataaaaaggtgaacgcgtctatagaaaagcgagaaaggcaagaatcaacaaaagtaaagtttagaaaaggaggaattgctattcaatgatagacactattaaagtgaacaacaaaacaattccttggttgtatgtcgaaagagggtttgaaataccctcttttaattatgttttaaaaacagaaaatgtagatggacgttcggggtctatatataaagggcgtaggcttgaatcttatagttttgatatacctttggtggtacgtaatgactatttatctcacaacggcattaaaacacatgatgacgtcttgaatgaattagtaaagttttttaactacgaggaacaagttaaattacaattcaaatctaaagattggtactggaacgcttattttgaaggaccaataaagctgcacaaagaatttgcaatacctgttaagttcactatcaaagtagtactaacagacccttacaaatattcagtaacaggaaataaaaatactgcgatttcagaccaagtttcagttgtaaatagtgggactgctgacactcctttaattgttgaagcccgagcaattaaaccatctagttactttatgattactaaaaatgatgaagattattttatggttggtgatgatgaggtaaccaaagaagttaaggattacatgcctcctgtttatcatagtgagtttcgtgatttcaaaggttggactaagatgattactgaagatattccaagtaatgacttaggtggtaaggtcggcggtgactttgtgatatccaatcttggcgaaggatataaagcaactaattttcctgatgcaaaaggttgggttggtgctggcacgaaacgagggctccctaaagcgatgacagattttcaaattacctataaatgtattgttgaacaaaaaggtaaaggtgccggaagaacagcacaacatatttatgatagtgatggtaagttacttgcttctattggttatgaaaataaatatcatgatagaaaaataggacatattgttgttacgttgtataaccaaaaaggagaccccaaaaagatatacgactatcagaataaaccgataatgtataacttggacagaatcgttgtttatatgcggctcagaagagtaggtaataaatttctattaaaacttggaaatttgatcacattaaagacccagatagacgtaaacctattgatatggatgagaaagagtggatagatggcggtaagttttatcagcgtccagcttctatcatagctatctatagtgcgaagtataacggttataagtggatggagatgaatggattaggttcattcaatacggagattctaccgaaaccgaaaggcgcaagggatgtcattatacaaaaaggtgatttagtgaaaatagatatgcaagcaaaaagtgttgtcatcaatgaggaaccaatgttgagcgagaaatcgtttggaagtaattatttcaatgttgattctgggtacagtgaattaatcatacaacctgaaaacgtctttgatacgacggttaaatggcaagatagatatttatagaaaggagatgagagtgtgatacatgttttagattttaacgacaagattatagatttcctttctactgatgacccttccttagttagagcgattcataaacgtaatgttaatgacaattcagaaatgcttgaactgctcatatcatcagaaagagctgaaaagttccgtgaacgacatcgtgttattataagggattcaaacaaacaatggcgtgaatttattattaactgggttcaagatacgatggacggctacacagagatagaatgtatagcgtcttatcttgctgatataacaacagctaaaccgtatgcaccaggcaaatttgagaaaaagacaacttcagaagcattgaaagatgtgttgagcgatacaggttgggaagtttctgaacaaaccgaatacgatggcttacgtactacgtcatggacttcttatcaaactagatatgaagttttaaagcaattatgtacaacctataaaatggtattggatttttatatagagcttagttctaataccgtcaaaggtagatatgtggtactcaaaaagaaaaacagcttattcaaaggtaaagaaattgagtatggtaaagatttggttgggttaactaggaagattgatatgtcagaaatcaaaacagcattaattgctgtgggacctgaaaatgacaaagggaagcgtttagagctagttgtgacagatgacgaagcgcaaagtcaattcaacctacctatgcgctatatttgggggatatatgaaccacaatcagatgatcaaaatatgaatgaaacacgattaagttctttagccaaaacagagttaaataaacgtaagtcggcagttatgtcatatgagattacttctactgatttggaagttacgtatccgcacgagattatatcaattggcgatacagtcagagtaaaacatagagattttaacccgccattgtatgtagaggcagaagttattgctgaagaatataacataatttcagaaaatagcacatatacattcggtcaacctaaagagttcaaagaatcagaattacgagaagagtttaacaagcgattaaacctaatacaccaaaaattaaacgacaatattagcaatatcaacactatagttaaagatgttgtagatggtgaattagaatactttgaacgcaaaatacacaaaagtgatacaccgccagaaaatccagtcaatgatatgctttggtatgatacaagtaaccctgatgttgctgtcttgcgtagatattggaatggtcgatggattgaagcaacaccaaatgatgttgaaaaattaggtggtataacaagagagaaagcgctattcagtgaattaaacaatatttttattaatttatctatacaacacgctagtcttttgtcagaagctacagaattactgaatagcgagtacttagtagataatgatttgaaagcggacttacaagcaagtttagacgctgtgattgatgtttataatcaaattaaaaataatttagaatctatgacacccgaaactgcaacgattggtcggttggtagatacacaagctttatttcttgagtatagaaagaaattacaagatgtttatacagatgtagaagatgtcaaaatcgccatttcagatagatttaaattattacagtcacaatacactgatgaaaaatataaagaagcgttggaaataatagcaacaaaatttggtttaacggtgaatgaagatttgcagttagtcggagaacctaatgttgttaaatcagctattgaagcagctagagaatccacaaaagaacaattacgtgactatgtaaaaacatcggactataaaacagacaaagacggtattgttgaacgtttagatactgctgaagctgagagaacgactttaaaaggtgaaatcaaagataaagttacgttaaacgaatatcgaaacggattggaagaacaaaaacaatatactgatgaccagttaagtgatttgtccaataatcctgagattaaagcaagtattgaacaagcaaatcaagaagcgcaagaagctttaaaatcatacattgatgctcaagataatcttaaagagaaggaatcgcaagcgtatgctgatggtaaaatttcggaagaagagcaacgcgctatacaagatgctcaagctaaacttgaagaggcaaaacaaaacgcagaactaaaggctagaaacgctgaaaagaaagctaatgcttatacagacaacaaggtcaaagaaagcacagatgcacagaggagaacactgactcgctatggttctcaaattatacaaaatggtaaggaaatcaaattaagaactactaaagaagagtttaatgcaaccaatcgtacactttcaatatattaaacgagattgtccaaacgttacagatggaacaacaatcagatatgatgataacggagtggctcaagctttaaatgtggggccacgtggtattagattaaatgctgataaaattgatattaacggtaatagagaaataaaccttcttatccaaaatatgcgagataaagtagataaaaccgatattgtcaacagccttaatttatcaagagagggtcttgatatcaatgttaatagaattggaattaaaggcggtaacaataacagatatgttcaaatacagaatgattctattgaactaggtggtattgtgcaacgaacttggaaaggcaaacgatcaaccgatgatatattcacacgtcttaaagatggacatctaaggtttagaaataacaccgctggcggttcactttatatgtcacattttggtatttcaacatatattgatggagaaggcgaagacggaggttcatccggtactattcaatggtgggataaaacttacagtgatagcggtatgaatggcataacaatcaattcctatggtggtgtcgttgcactaacgtcagataataatcgggttgttctggagtcttacgcttcatcgaatatcaaaagcaaacaggcaccggtgtatttatatccaaacacagacaaagtgcctggattaaaccgatttgcattcacgctgtctaatgcagataatgcttattcgagtgacggttatattatgtttggttctgatgagaactatgattacggtgcgggtatcaggttttctaaagaaagaaataaaggtcttgttcaaattgttaatggacgatatgcaacaggtggagatacaacaatcgaagcagggtatggcaaatttaatatgctgaaacgacgtgatggtaataggtatattcatatacagagtacagacctactgtctgtaggttcagatgatgcaggagataggatagcttctaactcaatttatagacgtacttattcggccgcagctaatttgcatattacttctgctggcacaattgggcgttcgacatcagcgcgtaaatacaagttatctatcgaaaatcaatataacgatagagatgaacaactggaacattcaaaagctattcttaacttacctattagaacgtggtttgataaagctgagtctgaaattttagctagagagctgagagaagatagaaaattatcggaagacacctataaacttgatagatacgtaggtttgattgctgaagaggtggagaatttaggattaaaagagtttgtcacgtatgatgacaaaggagaaattgaaggtatagcgtatgatcgtctatggattcatcttatccctgttatcaaagaacaacaactaagaatcaagaaattggaggagtcaaagaatgcaggataacaaacaaggattacaagctaatcctgaatatacaattcattatttatcacaggaaattatgaggttaacacaagaaaacgcgatgttaaaagcgtatatacaagaaaataaagaaaatcaacaatgtgctgaggaagagtaatctttagcactatttttatacaaaaatttaaggaggtcatttaattatggcaaaagaaattatcaacaatacagaaaggtttattttagtacaaatcgacaaagaaggtacagaacgtgtagtatatcaagatttcacaggaagttttacaacttctgaaatggttaaccatgctcaagattttaaatctgaagaaaacgctaagaaaattgcggagacgttaaatttgttatatcaattaactaacaaaaaacaacgtgtgaagtagttaaagaagtagttgaaagatcagatttatctccagaggtaacagttaacactgaaacagtatgaaaagctatgagttagatactcataatctttattcttttagaaagcgggtgtactgaattggggtggttcaaaaaacacgaacatgaatggcgcatcagaaggttagaagagaatgataaaacaatgctcagcacactcaacgaaattaaattaggtcaaaaaacccaagagcaagttaacattaaattagataaaaccttagatgctattcaaaaagaaagagaaatagatgaaaagaataagaaagaaaatgataagaacatacgtgatatgaaaatgtgggtgcttggtttagttgggacaatatttgggtcgctaattatagcattattgcgtatgcttatgggcatataagagaggtgaataaaatgtttaaactaatctttggttatagtttctggacatgtttttggttcggtaaatgtaaataagttttagtcagtgcttcggtactgactttttatttattgttgtaattatggtaatatgcagaagtgagcaagttggatagatggtggctatctgagtataaggaggtggtgcctatggtggcattactgaaatctttagaaaggagacgcctaatgattacaattagtaccatgttgcagtttggtttattccttattgcattgataggtctagtaatcaagcttattgaattaagcaataaaaaataaccatcgctaactttggctggtttcgatggttaaatggttattaatttaatctttaatctaaaatagccaccgtctttttaacgggctcattagggtaacatgtttgcgcatgttgccctttttctatatataaattaacacaccataatataaatatcaaatagacggcttattagtcgtctttttattttgggtaaaaggagataagaatatgattaattggaaaattagaatgaaacaaaaaatcattttgggttagcgatattgtcagctatctttttatttgctcaaaacatcgcaaaagctattgggtatgatatccaagtttatacagagcaattaacagacggtttaaacgctatattaggatttttagtattaactggtgtgattcaagacccgactactaaaggtataggtgatagccaccaagctttagaatatgaagaaccaagaagaaaatactaggaggtaaaataatgaaaacatacagtgaagcaagagcaaggttacgttggtatcaaggtagatatattgattttgacggttggtatggttaccaatgtgcagatttagcagttgattacatttattggttgttagaaattagaatgtggggaaatgcaaaagatgcaatcaataacgattttaaaaacatggcaacagtatatgaaaacacaccatcgtttgttccacaaataggtgatgtggctgtatttaccaaaggaatatataaacaatacggtcatattggtttagtgtttaatggtggtaatacaaaccaatttttaattttggaacagaactatgacggtaacgcaaatacgcctgcaaagttacgttgggataattattacggctgtactcactttattagacctaagtataaaagtgagggcttaatgaataagatcacaaataaagttaaaccacctgctcaaaaagcagtcggtaaatctgcaagtaaaataacagttggaagtaaagcgccttataaccttaaatggtcaaaaggtgcttattttaatgcgaaaatcgacggcttaggtgctacttcagccactagatacggtgataatcgtactaactatagattcgatgttggacaggctgtatacgcgcctggaacattaatatatgtgtttgaaattatagatggttggtgtcgcatttattggaacaatcataatgagtggatatggcatgagagattgattgtgaaagaagtgttttaattcttaggttaaaatgttaaatatttgttaattattttttaatgtaattttagtttcttttaatattttattgatttttaatattttctcaatataaaatgaagttgttgatatttatcatcttaaataagggtgttagctataaaaagagataaataaaaacaaatatattatatttggaggaagcgccatgctcaaaagaggtttattatttttaactgttttattgttattattctcattttcttcaattactaatgaggtaagtgcatcaagttcattcgacaaaggaaaatataaaaaaggcgatgacgcgagttattttgaaccaacaggcccgtatttgatggtaaatgtgactggagttgatggtaaaggaaatgaattgctatcccctcattatgtcgagtttcctattaaacctgggactacacttacaaaagaaaaaattgaatactatgtcgaatgggcattagatgcgacagcatataaagagtttagagtagttgaattagatccaagcgcaaagatcgaagtcacttattatgataagaataagaaaaaagaagaaacgaagtctttccctataacagaaaaaggttttgttgtcccagatttatcagagcatattaaaaaccctggattcaacttaattacaaaggttattatagaaaagaaataaaacaaaatagttgtttattatagaaagcaatgtcttgattgaatatgtgtagtgaaaattatctttcatcaaattctcattcatgcacgaatggttcttccccacctaatcagatattaggtgacttatggggagaaatcagttaggatgaaaaagtggataatccttttttaggcaggtacttcggtacttgcctatttttttatgttataatctttctagacgtattcaagggacgtctttttagattgtatgttatagctagctttcgggctagttttttgttatgatgtgttacacatgcatcaactatttacatctatccttgttcacccaagcatgtcactgggtgttttttcttatgatagagagcatagttttcatactactccctcgtagtatatatgactttagcattcccgtataatagtttacggggtgctttttatgttataattaactgtatatagtaggagtgaactatatagcctgttaagtggcctagtaacctaacacttatcctgcaattgatatcctttttgcccttcactcgatacatatatatcaacaacatagaaatattacagtcgctacaccgcatcttaaatggtgtggttatttttattggaagtgtgtatcaggtatcagtaatgttaaaacaccagctaaaaatgaaaagaattcaccagtgccagcaggttatacactcgataaaaacaatgtaccgtataaaaaagagactggttattacacagttgccaatgttaaaggtaataacgtgagggatggctattcaactaattcaagaattacaggtgtattacccaataacgcaactatcaaatatgacggcgcatattgcattaatggctatagatggattacttatattgctaatagtggacaacgtcgttatatagcgacaggagaggtagacaaggcaggtaatagaataagcagttttggtaagtttagtgcagtttgataattagatatataaaggtttggcaagttatgaaatgtctgccaaacctttatataaaaaagaaatatctaccttttaatttatgtaactactattagtatgcatattcattagtttttccaggaccattaattacataagatgatttagactctccttttttaaagaagtatgttttatacattttacctagtaactcaacattttttctatcttcagcaagtggtgtattcagatatactgtatagtaacctttattttcagttaaaataaccattttttcaaattgagcagaattttttgtgcctttctttaaataatttctcaaacgttcatctaattttcctagcgttgtaggaagaccactatttttaaatgattctttataagctttttctttctctaacattttcttatttgattctatttcttcatttgtaggaaacggttcaaaagtaaaagctttcgctgaatgatggtgtgtactgattcctgccgttaaaaaacttaatgctaaaactgttgttgctaatttctttttcataatgatgttaattctccttaaattctatatttaaatttatagttagttttgcgaaattcctaaaatgagtttaatctaatcgacgaaatatattaattaacttgaaattaataaaagattaattatttttaactaaaaattaaaattcaattagtgttttgatgaatttggtctcgataaattgaaataatctaaaaaacgctataatttttctattaatagtaattaatatgtgctatatttatcttagacacagcaatgtgttcaaattttcatctattcataagctagccttcgggctagtttttttgtgctatatatatttgttttaattaaataaaattagataatgcaatagtagccattttatgttaatattaccttgggcgttttcaaggagcgcctttcattttttatgtattgctccccttcgggctagtatattaaatttatttttgcgctttccaaatcaatgtatatgtgttatattgtttatgggaagtaggtaagcatttcggtgcttacctttttttgtttttctataaatacaataaggtatgtcaatttgataatttattaattttcatttaataagaagatctatatagttaatgaataattaatgtacttttttttagttagtcattaaaataaattagtactaattactaaggagaataaaaaatgaaaattagaaaatctatacttgcgggaactttagcaatcgttttagcatcaccactagtaactaatctagataaaaatgaggcacaagctagcacaagcttgccaacatcgaatgaatatcaaaacgaaaagttagctaatgaattaaaatcgttattagatgaactaaatgttaatgaattagctactggaagtttaaacacttattataagcgaactataaaaatttcaggtcaaaaagcaatgtatgctcttaagtcaaaagactttaagaaaatgtcagaagcaaaatatcaacttcaaaagatttataacgaaattgacgaagcactaaaaagtaaatattaaaaaaaccacccttttacgggtggttttaattttctagataatataaaagtgttcataaataaaacagtataggcaaacaataaagtattgaaaaaagtaagtttaatatgaaaattgttaaatgaacgacatcttttgtttttataaatatcaagaaaataatcaaactcaaaataaataacgtaactgtagtcataggcgtccatacataatcagcattagtcattaagaatggtgcagccattatgaaaaaatttataatgcagatgaaatagacaattagactataaattagataaataacaatacacacccttcataaataaataatttaaatcctatatattttaacaaaagtaacacacagaagtgtagaaaataaaaaatattggtaaataaaatcaataagtttaaccaatatgttgctcgcttcataccgtatattgcaacaaaaattccgattaagaaaaatatagcccctatgataaaacagaaatccgatgctgaattattaaaaaatgaggtgtttagagttagaaaatgagttaatgagttgactataactaataagatattaattatatttgtatggttcttcacatgatacctccaagtaaaaaaatctaattaataaagtgaatgcttgatgaacaagcagttattccaaacagaatcaataagaaaagtagaatcaacatgctaatgccccataaacaacccttttcactttctctattattaatttcttgacttcttttaaagatattattacttttacattctttagttgttttaaatttcacgtttttattacttccttttgtctaaaagtttacaatgaatttttgattataataatatattcaaaatagtactatctagtttgatatgtcaagcaatattattataaaattggaattctgagttgtctactctaatttattatatttacctataaaaatacacctcaaaaaatagatttttcagtctagcttttggggtgtacattccacacaaacatgtgattattttgatgtttctattaaacttgtaattttaaatttaaagtccctaaaaagtccctaaaattttattttatatgaggtattattgataatgataaagttataaaccttgatattatgctgttttactttttgaatgataagtaattttatgttaaaagtctccagtttggatacatagaaaccttgtaacaacagtatttattgggtttggagtccctaatgggtccctaaattacatactttctaaaattttagttgtttttttgtcctcttcattaaatttttcttctaacaaatgagaatacacggatgtagttattgctatatttttatgacctaatcttttagaaatgtaatgtatagatacaccttttgctagtaaataagaacaatgagtgtgtcttaatgcgtgcgatgtaataattggtatattattgactctacaggctgatttcaaagcattattgatagcctgaaggttaattatagatccggcttctttgaaaatgtaaccatcatagctaattgcaaatgtacttatgacgtccataatgtgtttcatatcagatttagcgatactgatatatctaggggaagtatcggtttttcgctcgtcaataaatatagtgtttttcacttggttgatatgctcaatctttatatttcttgcaccactgacacgacaacccgtacaaatcattatgaatagcgctaatgatgaacgagttctcttctttctgacgtgatcttttagtatttcatattcagttaccgagatgaatttttcttgttctgacttcgtaggttttccggctttataattaactttataagcgggatttttaaaaataagcccatcatataatgcgtcatctaaagctgaccgaatagcaccgtttgtttttcttatagtttcttttgcgtgttcttttgaataatcgtttatgaatttctgataaacttgtctatttatctttgataactccattttacctattttatgtttttgtatatgttgtaatgcatttctataatgacggtaggtattttctttaacaacaggttgtttatacgttttaatccaattttcgaagtattcttcaagagttatatagttatctatattaaaaccacttcttaactcatttaacttgtctagtccagcagaattagcttcacgctttgttctaaaacctttcttacggtatctttttccttcatacttaaattcatattgccattttttaccatcgtaacaacgtgttttcatgcgttccctcctcaaaattggcaaaaaataataagggtaggcgggctacccatgaaaattgtataaaaaaagacgcctgtataaaatacagacgccacttatagttataagattacatggttaattaccaaaaatggtaacgaatatatacgtgttttaaaggataaacctttaatatattaaaattatatcatcttatatcaggaatctgcaatatattattattaattctatttatcagtaacataatatccgaagaatctattactggatttttaattttttggggtaaaacttttcttatgcgaaacttactaatcggctggaaagaatttatgcaagcgtaactattaccttttaattttttttaccttatcaattgctgatactatgttattaatgtttctgtcaattttatttaatttattttcaatttctaaactatcagatataaattcactaaaataatctttagtgatgaattctgtgttgttttttggtattttttatcgaaacttcttttaatatagctgaattattttgcgcgctaattaaatttaaaaacaatcttaaataatactcccatttcaaatcaaaattcatctttaaatactttttgttttctttagaagataagggaataacatttactatatcttccgtattagaatcatttttattcatcactattgcaaagtgtgaattagagaattctttattaacgtttataccgaaatctacaaaaactatttctccttgtttaaactttggataaaaacctttatggtttttttcaccttcaaatctcttgagtaaatagtgaatatctgaatctaattttttaaattttggatttccagaagtttttaatttattaatgcgtttttctatattatgcgtcatcatttctcctttattctcgctcacactctcaccaccattcaacgtctacactagtaggtcgtttttttatttagtaaaatcataatgaatcttctttggttaacttatctccatcttattttttgtgaaataaattccaagtatttacgcgcattatgtgacgataaatctttaggtaactcataagtgaatggttgattaccactagttaaaacttcatatactatagtttctctttttattttgcaattagttattttcattataaacttcctttcaaacactgctgaaatagacgtcttttatattaaagcgccacacaggcgctgttaatcacaatttagttctatcagtgattttagactccataactctttgatgtgattctttagcttctcgaatcatatctttaaattcttgactgtctataaaagctttagcctcttctatttgctcttgagtaagctctttaccaccagtattgatgtgtaagtgttcaatttctttataagtactcattttttcgactcctgttcttcaagttcacttttagttataggtaaaccattgttcaatctataagtcagttcttcttctgtataaaaggggatttcaaccatttcccactcttcaatgttaatgtcaacttctttaaaatccatgttaaaccctcctgtgaaatgaattttctattatttatagtaattacttataaaaatacaatctttacctatctcaaactttgtattctaaatgtactcgtaatccatagtctgattctttagtaacgattttctcttctaaataatctaagttttatacttaccaccattaatatatgcgttacaagaaacgatgttgtccatatgattgactaatcttgaagcatactctctaggtacatatccaacgtgaaattcagagtattcatttgaaatcataacttttatcgcgttttcatcataaggattatccggttctttttgtaagaatacaccaggaataacctcgtaatcagaaatttcatacaccttgtcttcataaagtaattcttctttaagttcatttcctttcaaatcactatataagaaaaagaaatcgtcgttatttttcattttcttgataagtttctttaattcttttctacgaccttcataatttaatcctacgacgtcgaaaatttcaactttagtttgttcatcatcattaataggtagacaatcattcgagataattgtttccttattcttagataattgcatataagtttttaaaattgagatgaatcctgttaaaggagagtttgttacgaaataaactgttaattttctattatcgtttaatgttaaaaaagcttggtttttccaaatagtaacaacagtgttataatctatcacctctgataatgagattttgaatatataatcttcttctttccttataaaacaaatctcttcatgtgaaatgaatatagaacccattctcctcttgttttcgtcgaattttatgtcgcaactgtcgctgattattggttcaaagtaactgtattgatctgataatattttttcatcttgctttctaggtttcattttactacctcctataaaataacttttccaactaacctcacactttcgttatcataaaatataatctttatactttttatttaaagaaaccaacgttaatctattatcttctacataaactttctttacgtaagcatctccatttataataaagacgcctatttgtccatctttgatagtgtgagatttttcaatgaatataatttgtccgtttttaaataacggctccattgagtctccatttacttttaaagctatatcatgtgcggggacataacctcttacgaattcttttgaaataggctcgttatataatctttcgccaataccagctgacgcacaaccatatatatccacttcggatttttcttgaatgtaagaattgaaatctaccagattatcactgtcattattttgttcttctaattgattagtcgcatattttagtacattgctttgtcttggaggcgtgagtttactgtatatggaagtgatgtcgttattttcaatttttctattcttagaaatatcaaaccccataagccacgcttcgttaacgtttaaagcctttgctagttcaaagactttgtcttgtttcgcttcatattttccgtttaaataatcgctaattgagtttctaccaataccagtccttcttgatagctctgattgagatatcttccgttcagacataatttgctttaatctatccttaaaactgttcatatttctgaacacctcctaagaacataatactacgtacaatgacgattatcaataattttttaacaaatattgtacagaaaaatgtattttatgtgttgacttatttaaacaaaggtgttttaattgatttgtacagaaaaccgaacaagaagggaggtgagtttatgatatacaatttcgattatagtttgctgtacgaaagaatggcagagtatagatatagccaaagttctttagcgaacgcaatccctatttcaaggacatctattaatcacaagttgcaaggaaaaaatttatttacacaatgggaaataaaacgaatctgtgaattattagaaatcccaccaacaaaagtaggtagatatttttttgaacaaaatgtacagaaacctgtacaaatgtcgtaacaggaggaaactatggaacaaatcacattaaccaaagaagagttgaaagaaattatagcgaaagaagttagaaatgctataaaaggcgagaaaccaatcagctcaggtgcaatttcagtaaagtaagaatcaataatgacgatttagaagaaatcaataaaaaactacaatttcgcaaaagaatttgtcgctaggaagattgaggaagctcaatcatccgattccgctaaaaaaagtatcagcatggcttcgaatcaattcatcaaaaagcttatgtacaagatgttcatgaccatattagaaaattaacattatcaatttttggagtgacacttaattcagacttgagtgaaagtgaatacaacctagcagcaaaagtttatcgagaaatcaaaaactattatttatacatctatgaaaagagagtttcagaattaactatcgatgatttcgaataaaggaggaacaacaaatgttacaaaaatttagaattgcgaaagaaaaaaataaattaaaactcaaattactcaagcatgctagttactgtttagaaagaaacaacaaccctgaactgttgcgagcagttgcagagttgttgaaaaaggttagctaaattcaacggtaaggatttgccctgcctccacacttagagtttgagatccaacaaacacataagttttagtagggtctagaaaaaatgtttcgatttcctcttttgtaacagtttcaattccttcatatcctggaaaaacaattttctttaaatccgaaacatgtttttttgaaccatcctttaaagtaactagaagtttcatacttatcacctccttaggttgataacaacattatacacgaaaggagcataaacaatatgcaagcattaaaaacaaaatcgaacatcggcgaaatgttcaacatacaagaaaaagaaaatggagaaatcgcaataagtgcaagagagttatataaagctttggaagttaaaaagcgttttagcgcttgggcagaaattaacttgaagcatttcaaagaaaatagggattttacaagtgtacttacaagtacggttgttaataacggagctgtaagacaactagaagattatgctttaacacttgatgtagctaaacatgttgcgatgatgtcaggtacagaaaaaggttttgattttagagagtatttcatccaagtagagaaagcatggaacagtccagaaatgattatgcaacgtgctttaaaaattgctaacaacacaatcaatcaattagaaacaaagattgaacgtgataaaccaaaaattgtatttgcagatgcagtagctactactaagacatcaattttagttggagagttagcaaagatcattaaacaaaacggtataaacatcgggcaacgcagattgtttgagtggttacgtcaaaacggattccttattaaacgcaagggtgtggattataacatgcctacacagtattcaatggaacgtgagttattcgaaattaaagaaacatcaatcacacattcggacggtcacacatcaattagtaagacgccaaaagtaacaggcaaaggacaacaatactttgttaataagtttttaggagaaaacaaacaacttaataggaggaacgaacaatgcaagctcaaaacaaaaaagtcatctattactactatgacgaagaaggtaatagacgacccgttaatattcaatacaacgatggctacgacttaatgatagaccagcgttttattgaaatgacgcttgaaagacatccgcatttaaaaaataacttttatggattaatagatggaaaagaatttaagttagattaaatttttgtgttagataattaaaagctaatttgcttagcaatgttacggacatactagtggttttgtttgcgacttttttaacttctttccaagtgtgattgtctcggatattatctaaaaattcatgccctgaccaagttatatcgttaattgtataaccataaatatgtccatcttcccaaccgaatttaacactaacatactttgcttcttccagttttaataatgcatacattacagtttcaaaatcatattttccaaatacaacattatctttgaaattgtattcggtgagcggttcaccaatctttttattagtttcaatttctaacaaaagatgtctaacacaatcatgatctaatttcatacttatcactaccttaggttgataacaacattatacacgaaaggaaagatagaaatgccacatattttaaacgtaacagttccaatacctgaaacacacgtgcttatcacaaaagatgaatatgaagagttaatagcttactcattagaccctgtatggaacatgagcgacttaaagaagaaattaaaaattgcatctgatgaaacaatcaaagacaggttattatttcaccctagactcgaaaaagagttaagagcacaaggtatcgtacattatcctgatgagaattttaatcgttggaggtttaacgcaagaaggatgcataagtttgtagatgaacattttaatgagatttacaaaggagggcacaacaaatgagtaaaacttataaaagctacctagtagcagtactatgcttcacagtcttagcgattgtacttatgccgtttctatacttcactacagcatggtcaattgcaggattcgcaagtatcgcaacattcatattctataaggaatacttttatgaagaataaaaaaactgctacttgcgccaacaagtaacagtaacaaacatttaagaaataaaattcaagttaaatataaaacgaaaaacggaggaagtcaaccatgactaaaaattataaagacatgacgcaggaagaaataaaagacttattatctgaaaaaacggcagaattgtatgaattagcgaaagaaattaagggagaaagtaaatttgatattttgcttttctcatcaataggagttatcgacggagattatttagcaggttcaagttctgtgattggtcatacttttgatcttgcttacttattggatagcactaagagttataaagatattgtcaatgttctccaaatgtgtaaatcacaaaaaattctcggtatagatgacgacaaggaggactaaaacaatgtattacaaaacgggtgacgtatgtcgaaaaatatttaatgtagatggctttgattttcaattaagagttaagaagcgagcatatagtgtcgaaatagtcgttttagatcatgaaggaaattcaattgacgggctactagtttctgacgagaacgatctatacacagctttagatattttgaaacaaagtatttatgaatggattgaaaataacacagatgaacaggacagactaattaacttagtcatgaaatggtaggtataagcatgagagatacagaaagaaatatattgaatatttttaagacgttattcgacgaatatactttgtcaaaccaacgagcattattggaaattgaacgtaatcatcacggatacttatcgattaatttcttgcactatcacgacagttacaaaacaaacaataagcttgtgcagatacatgaaatcaatccagacagccatgaacgaataaaaaatttaattatcgaggtgctaagaggtcatcggaagattaaaaaaggagcatgaggaaagatatgaaaataaataagttaactatatcgaactttgctggaatcaaagaagaaaaatttaactttgacggtaaagatgcaaaaatatacggcaataatgcgactggcaagactacaacagcaaccgcattacaatggctgcttttcgataagggtttagacggttcaaccaaatcatttaaccctgtacctttaaacgaaaaaaacgaagaaaattatgagttaattccgactgttttcgcagaatttgaaatcgacggaaaaattacgacttttaaaaaagagtcacatcctaagtacacaataaatcaaaaaacgaatcgcaaggaatactcacgaagtcgaacgaagaaacaatatatcaatgatgaatcaataaaagtaaaggattataaagctcgtattgatgaactgattgatgaagatgtattcaagttaattacgaaccctcaagcatttaacttactagattggaagaaacgaagaagtttgttgtttgaaatcgctaaaccaatcaatgatgaggatgtcattaaaacaaatgatgattttaaagaactaaataatattcttggagatcacgaaattgaaacaaagaaaaagattcttacagacaagataaaacagattaacaaagatatcaaagatattccgatacgtattaaccaaacgcaacaaaataagcaggatgtaccggaattcgataatgatagacacacaatcataaaacaagaaattgagcaacttgaaaatgagcgtatagatattcaaaacggtgcagaagaaattaatttgcgtaaccaattagctgataaacaatcagaattgaagcgcatagaagctaataatagcgccagtaatgagaacaaaatacatgctttaacaaatgagctacacgttgaaaatggaacggttgcgaatcttaaaacaagattaaagcaaaacaaacaacaaattacacatgaagaaaatcgacgtaatcaattattagaaaatcataaaggattaaaaagtgatttagaaaaagctaaaaatcaaaaatttgaatatcttgatgacaatgtatgtagttgttgtggtcaacagttaccagctgaacaagtgagtgaggtaagagaaaaagcattgcagaaattcaatgcaaacaaatcgaaagaattagaaacaatacaaacatctatcaatcacattatttcagagggcaagaaaataaagccaattatcgagaaattagaggatgacaacaataatttacaaattaaaatcaacgaagcagaagagcgttcagcaagaatacaaaacaaaattaataagttgaaaataactcacgttgacgttacgcaaactgacgaatacaaagcagtaatgttagagataaatgagattaatcaaaaacgctctaacatcaggaaaactattcaagataaagtttcaggaatagatgacaaaataagcgaacttactcaagaaaaatcagaaattgaagtgtcaatatcaatcgaaaaatcaaataaacatctagatgatgttatttctgaattaagaaatgaagaagacagattattggatgaaaaagaaaagtattcacatgacctttatatcttaaaagaatttacaacaacaaaagtcaaaatgcttactgaaaacatcaataacgaatttgatattgctgaatttaagctattcaataccttagttaacggcgaattagaagaaacatgttcaacaacggttaatggtgtcgagtatgacagcggtttaaataacgcctcaagaattaatgttggcttagatatcatcaacacactatcaaaacattttaaagttacagcgccaatatttattgataatgctgaatcagtaacagagcttatcaaaacagaatcacaacaaattcaattgatagtaaatgaacaagataaaaaattaagaatggagactatataaaatgacgaatgaattactattaaaaaacaataaaataggcggacaacgttctatctagagttaagacattagaagcacaaggagatttacagtttcctgcaaactattcgcctgagaatgcaatgaagtcagcaatgttacaactgcaagaattaaaaggatctaaaaaagatggttataaaccagcgctggaatttgcaacttcaaccagcatagcaaacgccttaatggacatggttgtacaaggtttaaatcctgctaagaatcaaggctatttcattatgtatggcgataaggttcaattccaaagaagttaccacggaacaatggcagtaactaaacgtgtagcaggcgcagaagaaattaatgcagaagtcatatttgaaggtgacgaagttaagtataaaactaaaaacggaaaaattgttgaacttgaacatacacagtcttttggtaacagaaacacacaaaacattatcggtgcatatgcaacagttgtatttaaagatgaaagtagaaattacactgaaatcatgacatttgaagagattgaagaagcgtggaagcaatcacaaatggtttataacggtgtatttaaagaagacggtacacacagaagattccctcaagaaatggctaaaaagactgtaataaaccgtgcatgtaaaaagattttaaacagcacggatgacgctagtcttttatcaaatcaaattaaagaatctgaacaacgtcaacgcaaagaagtattggatgcagaagttgaagaaaatgcaaatcaagaacaattggattttgaaccaccagtttttgaagaagcacaatacacagaattagaaaatgaaaaacctattgatgtatctgactttgaagaaataaaagaacctgcaacagaaaaagaaagcgaagaagagccattttaattgaaacaatagcaactggttcaagtggtaactgctacgtcttaaatgatggacgtactacgttactgcttgaggcaggaataaaatttgaacgtgttcaaaagcatttcaaatataaaacaagacatatagcagggtgtcttatcacacacgaacatggtgatcatgcaaagtacacaaagcagtttgtcgacaatggtgtaatcagctatatgactgctggaacacaacgagctatggattttgaaagtcatcgcttatgcacgattaaggcaaagcaagagctacgaattggtacgtggtcaattttaccatttgacattgaacatgatgctaacgagcctgtggctttcttattacaaagcacattaggttataaggtcctgtatgttactgatacgaagtatctgaaatacaaatttaacggcattacgcacatgatgttagaagttaattatatctatgaacaaatgcaagaaaacataaaaaacggcagtgtacacagcgcattagcaaacagaattatggagtctcattttagcttagaacatgctatcggaatgttgaaagcaaatgatttaactagactcgaagaaatacatttaattcatttaagtagtcaaaattcaaatgcaaaatacattaaaagtgaaatacaaaaagtgacgggcgcgcccgtttatgttggaggtttataaatgctaaacagaacaatattagttggtcgtttaactagagacccagaattaagaaccactcaaagtggtgtaaatgtagcatcattcacattagcagttaaccgcacatttacgaatgcacaaggagagcgcgaggcagactttattaatatcatcgtatttaaaaaacaagcagagaacgttaataaatacctatctaaaggatcgttggcgggcgtagatggtaggttacaaacgcggaactatgaaaataaggaaggtcaacgtgtatacgttacggaagttattgctgatagtattcaatttttagaaccgaaaaactcaaatgacactcaacaagatttatatcaacaacaagtacaacaaacacgtggacaatcgcaatattcaaataacaaaccagtaaaagataatccgtttgcgaatgcaaatggtccgattgaaatagatgacaatgatttaccattctaatttaaccggtttgaaagtgaggtgtgtatatgactggttggataagtattgatcgctcaattcaaaatcattggctatttaaagaaaagagaacattttcaaagtttgaagcatggatatatttactcatggaagcgaatcattcaaaggcaaaagtgcctattggaaaccaaattgtaaccgtagaaagaggacaaagattaacatcgattttgaccttgtctgacctttttaactggtcacgatttaaagtgaaaaccttccttgacttactcgagagtgatggaatgttagaagtcaaaacaacatcaaaatatacccttataaccattgtcaattatgacttttatcaaagtgagcagggcaggaaccaacatcaaaacgacatcaaaccaacatcaaaacaacatcagtcaaacatcaacccaacatcaaaacaacatcaaaccaacacaaacaataatgataataaagataataatgaaaagaatgtgaataatgagaagaagaagacaaccgccttcgacttcttccaagataacggattcggtttcataacttcttacaatttagacgatttaaattattatcttgattcatttgaaaatgattcagatgaaatagttaccgcatcacttaaaatcgctaaagacagaaacaaagttacttggggatatgctaaaagcattttgaatacatggcttaatgcaaacttgaaatctattgaacaagtacgtgcatttgaaaagcaacaacttgaaagcaaaaaacaaaattataaacctttcgttaaacaatcaaaagaaaaaacaacccaaatggctcacagacagcacgagagaaacgaaaacgccggaagtagatgaaaaccttgagaaagacagagaagcttttattaagcgtctaaatagcaaatgggagtgattgaaaatggatgcatttgataaatactatctatttgatcatgacggcaacaaaatgttttcagttacaccacattttaaagatggtcggcatttagttgttggaataaaagaaacaaaatttaatggtcgtcgttggtatttagacgattatgaattaaatacacttattgataatgaacaaatggagttaggacaccaaacaagcttatttgaatatatatgagggattacatggagatagaaattaaatttaatgaagtgtttaatgcgccgatggggtcgcctcgtccacgctttcgtaatacaggtagatttgttcaaacttacatgccaacgtcttacacaaagcataaagcgtatatacaagggcaaatgcctaagttaaatctagagcgcgcactaaaaatcgaattagacttttactttccattgcttaaatcatggtcgaagaaaaagaaaagcgaaatggttgggcagtataaagtgactaagccggatatcgacaacttaattaaaacggtattagatgcttgtaatggccatgtatggaaagacgataaccaaattacagaaataactagctcaaagcgttatggaattgagcccaaaataatcatacgaatagaagaaatataagaggtggataaaatggcgagaaaagcaaggattgtaacaataaatgataaaccttataggttcagtaaatttgaaatggaattaatagaaagtcacggtataaccgctggaatggtttctaagagagtaaaagacggttgggaactacatgaagcaatggacgcaccagaaggtacgcgtttaagcgagtacagagaaaagaaaacaatagaaagactggaacaagctagactcgaacgcaaattggaaagaaagcgaaagagagaggctgagctaagaagaaagaagccacacttgtttaatgtacctcagaaacattcacgtgatccgtactggtttgataatacttataaccaaatgttcaagaaatggagtgaagcataatgagtgtaatcagtaacagaaaagtagatatgaatgaaatacaagacaatgttaagcaaccagcgcactacacatacggcgacattgaaattatagattttatcgaacaggttacggcgcagtatccaccacaattagcatttgcaataggtaatgcaatcaaatatctatctagagcaccgttgaaaaacggacacgaggatttagcaaaggcgaagttttatgtccaaagagcttttgacttgtgggagcaatgactatgacatataacgcgcgcaaagaatacttaaaccaatttttcggatctaagagatatctgtatcaggataacgaacgagtggcacatatccatgtagtgaatggcacttattactttcacggcatatcgtgccaggttggcaaagcgttaaaaagacatttgatactgctgaagagctcgaaatatatataaagcaacatggtttggaatacgaggaacagaagcaactaactttattttagaggagatggaaatgatgaataatcgtgaacaaattgaacaatccgttataagtgctagtgcgtataacggcaatgacacagagggattgctaaaagagattgaggacgtgtataagaaagcgcgagcatttgatgaaatacttgatggaatgacaaatgctattcaacattcagttaaagaaggtattgaacttgatgaagcagtaggaattatggcaggtcaagttatctataaatatgaggaggaacaaggaaaatgactaacacattaacaattgatcagttacaagagttattacaaatacaaaagaagttcgacgatagaataccgactagaaatttaaatgacacagtagctagtatgattattgaatttgcggagtgggttaacacacttgagttttttaaaaattggaagaaacaaccaggtaagccattagatacacaattagatgagattgctgattacttagctttcagtttgcaattaactttgactattgttgatgaagaagatttggaagaaactactgaggttatggttgatttgattagaaaatgaagttactttacctaaactacattcagtttatttttgttcatgtaatgcatacactaacagaacaatttgtaaaaggtattgataatagtattgtacaagttttaataatgccttttttgtacgccaatacttactatacaatcgaccaactcattgacgcatacaaaaagaaaatgaaaaggaaccacgaaagacaagatggaacagcagacgcaggaaaaggatacgtgtaaagacatcttggatcgagtcaaggaggttttggggaagtgagcgacatgttagaaatatttttaatagggtttggcgtttatctcttttatcgcatagcaattatttttcttaagagtaaaaagactatacacacaaacatatatgaaatgttaatgcttgctactatctttatgatatctacaattgcttataaacatcaaaagacgcatatcttaatagcatttttagtaatgttttttatgagtaagctcaaacaagttcaagggagctatgaggaatgacacaatacttagtcacaacattcaaagattcaacaggacaaccacatgaacattttactactgctagagataatcagacgtttacagttgttgaggcagagagtaaagaagaagctgagcgcaaatacgaggcacaagttaaaagaggtgcagttattaaattagggcagttgtttgaaaatataagggagtgtgggaaatgattaagcaaatactaagattattattcttactagcaatgtacgagttaggtaagtatgtaactgagcaagtatatattatgatgacagctaatgatgatgtagaggcgccgagtgattacgtctttcgagcggaggtaagtgagtgatgtggattactatgactattgtatttgctatattgctattagtttgtatcagtattaatagtgatcatgcaagagagatacaagcactcagatatatgaatgattatctacttgatgaagtagttaaaactaaaggatacaacgggttagaagaatacaggattgaattgaagcgaataaataacgatattaaaaagtaatttatattatcggaggtattgcattgaatgataaagattgagaaacacgatatcaaaaagcttgaagaatacattcagcacatcgataactatcgaagagagttgaagatgcgagaatatgaattacttgaaagtcatgaaccagataatgcgggagctggcaaaagtaatttgccgggtaatccgattgaacgatgtgcaataaagaagtttagtgataacaggtacaatacattaagaaatatagttaacggtgtagatagattgatagatgaaagtgatgaggatacgcttgagttattaaggtttagatattgggattgtcctattggttgttatgaatgggaagatatagcacattactttggtacaagtaagacaagtatattacgtagaaggaatgcactgatcgataagttagcaaagtatattggttatgtgtagcggacttttaccctatgtaagtccgcattaaaacagtttattatgttagtatcagattaatatttaaggttattaaatgctaatacgacgcatgaacaagaggcgcattactatgtgatgtgtctttttatttatgaggtatgaacatgttcaaactaattgtaaatacattactacacatcaagtatagatgcgtcttgatactacttaagttatataaggtgaaacattattatgactaaagacgaacgtatacgattctataagtctaaagaatggcaaacaacaagaaaaagagtactagaaagagataattatgaatgtca

SEQ ID NO: 8 - protein, 68 aa, Unknown
  Description of Unknown: Undetermined Phage F168/08 polypeptide
WTSFFHNIVGYDEPLSKEVLTAYHLKEITDLNELPEHHKKVFETLSAIEYSTVEQALKTFKTNYVEGI

SEQ ID NO: 9 - protein, 90 aa, Unknown
  Description of Unknown: Undetermined Phage F168/08 polypeptide
MEFLKYPSLVNHYAIGKSKRLVNRFDNILWYASEKIHGANASYALSATGEEYFAKRSGIISKDDKQFSMLPECVTSDIREGTKKAFRILS

SEQ ID NO: 10 - protein, 258 aa, Unknown
  Description of Unknown: Undetermined Phage F168/08 polypeptide
MEPTLLMPYQQLGKSISQSVVELFLKTINNFQCFQNVLPQTFEKVPKKLFEYYPKAESIHVFGEFFGKGVQVMDYDLVKEGKKAFRVFDVIAKYDDGSMAVCGINTWKHLFEQDSIVPYYTLGKTLKEFLETPPSEESALGGYSEGVVLKPLQGYPINSTQDFLGVKYKTEKYLEVRHKPSEQRKKPPKLNNEQVEALNELGKYITKQRVLNVCSHGDFELIQNNIGKIMLAVKQDAANEFIKEVGSSFTEKRACRSL

SEQ ID NO: 11 - protein, 101 aa, Unknown
  Description of Unknown: Undetermined Phage F168/08 polypeptide
MDFNTLIEQVQEWSANKGLDKAAPEKQFLKVIEEVGEVAAAMARNDREELVDGLGDTFVTLIILCQQLGVVPHEALDTAYGVISKRTGKMVDGVFVKSEDL

SEQ ID NO: 12 - protein, 107 aa, Unknown
  Description of Unknown: Undetermined Phage F168/08 polypeptide
MMKLIELDNGRKQVFYNNVLMQYERRGSDVYGNPLYRVYPINFSFKRLKSVYRNYEKGGWEESYYLIQSYNILADMQNIASEVNAKNTFPEFDQTLLKDYREVSAYV

SEQ ID NO: 13 - protein, 83 aa, Unknown
  Description of Unknown: Undetermined Phage F168/08 polypeptide
MALTMFEKESLQKENARLKRELATLKASQKLGGGLNEKELQKALNSCQRIFKTLNRGKRSLVLSKSAMVASVEYSGSGRSKNL

SEQ ID NO: 14 - protein, 52 aa, Unknown
  Description of Unknown: Undetermined Phage F168/08 polypeptide
VVAQKTYKDCSKTAIREAEKSAWEIMSLENDFRNIHHFLKHGTMKAEDKDNA

SEQ ID NO: 15 - protein, 22 aa, Unknown
  Description of Unknown: Undetermined Phage F168/08 peptide
MLNIIVTVISTAAVFKGARNGE

SEQ ID NO: 16 - protein, 97 aa, Unknown
  Description of Unknown: Undetermined Phage F168/08 polypeptide
MVNKKLSDRLTKSIKFSRKKAKKRFIIARVTEEQAYTLRLLKAISKEDEAVCKATNKALLEYGYEEAGGHSYEKAREKFSSLPDVKKWHTNRRTRKR

SEQ ID NO: 17 - protein, 77 aa, Unknown
  Description of Unknown: Undetermined Phage F168/08 polypeptide
MTKNHYKLYVDMKEGTHDYVSATVYSMFDEKVLWLPDIKKPENVADYTDEWKNGLYSYYEKLAISELNDYNATFSHL

SEQ ID NO: 18 - protein, 152 aa, Unknown
  Description of Unknown: Undetermined Phage F168/08 polypeptide
MTEFANMNKEEVLELLNDWFGVSDYVTVMAELEKMKQVTFTGSTDIPLLGGNNDLIGLPQFFKGNEVEPEFPTYEELLEELEKDTWNLEAEDNTYNYSGFLERDMDFKTIHAENSDTTIAFFAIHTGGRHKSGLLKSNPIYFLKLTTIFKSS

SEQ ID NO: 19 - protein, 92 aa, Unknown
  Description of Unknown: Undetermined Phage F168/08 polypeptide
LFFETYYDFQEFLGNYFYGQGYYAFKHDNKEYTISLDISATSEYVRIYISDENNEELQQSYEQETFMDLDREGVEAYLKDEGIEFTDLKHAL

SEQ ID NO: 20 - protein, 48 aa, Unknown
  Description of Unknown: Undetermined Phage F168/08 polypeptide
MENNKAYERLLKEVELLQNDLMDIEDYSEEVYQAFQKVIDELEYIQAS

SEQ ID NO: 21 - protein, 52 aa, Unknown
  Description of Unknown: Undetermined Phage F168/08 polypeptide
MTKQFKNIIATLTILVIALAAASGIATIKAVENANDKAILAERVEALEKTFR

SEQ ID NO: 22 - protein, 62 aa, Unknown
  Description of Unknown: Undetermined Phage F168/08 polypeptide
MIKLSLPNVWKLWKKLSDKQEYDIAVKSNVIGAYLINHEEEAQKEYTEAYKAHKPTLLKKLP

SEQ ID NO: 23 - protein, 65 aa, Unknown
  Description of Unknown: Undetermined Phage F168/08 polypeptide
VRGFSEGYLKGVSGRNLKANLERQVESFVVDLFFIKGNEKPLRNAVAAGLWERWLERLSDSFQID

SEQ ID NO: 24 - protein, 59 aa, Unknown
  Description of Unknown: Undetermined Phage F168/08 polypeptide
MVPNPSYNLINACVNTPLERGKASRAADKRRPLYLWNLFLKGSKEEPSGKVALKLSDVY

SEQ ID NO: 25 - protein, 42 aa, Unknown
  Description of Unknown: Undetermined Phage F168/08 polypeptide
LTWPLFLWYTIRNDKKGVLKAMLERIKGMLRKIRLANGLATA

SEQ ID NO: 26 - protein, 64 aa, Unknown
  Description of Unknown: Undetermined Phage F168/08 polypeptide
MVAGIQKISLSKGKPVKGVNIKTGEEITFQTVSEVISYGFDKSHVASCARGESKTHKGFIWKYV

SEQ ID NO: 27 - protein, 120 aa, Unknown
  Description of Unknown: Undetermined Phage F168/08 polypeptide
MVEWRDIEGYEGLYMVSDQGDIFNCSRNSLMKLRKDRKGYLLVGLTKKGNQKTYRVHRIVANAFINNIFKKPQINHLNEVKHDNRVDNLEWVTNKENSNYGSRNTKNKFKQRKACKRSKY

SEQ ID NO: 28 - protein, 69 aa, Unknown
  Description of Unknown: Undetermined Phage F168/08 polypeptide
MNWKAFRLVSLYYLLALVIAFGLIVVITLVFGASVTIAIGRILGNLIILKVIWDMLHKEYEEAKEDLEK

SEQ ID NO: 29 - protein, 76 aa, Unknown
  Description of Unknown: Undetermined Phage F168/08 polypeptide
LSEKLTKRIILAAVIIAYLITVGIIFGILWLVSLITGWEQLFFYLGVLFLIDLLWETTKYAFIRYNKDKHKTLEEL

SEQ ID NO: 30 - protein, 232 aa, Unknown
  Description of Unknown: Undetermined Phage F168/08 polypeptide
MLFKKDENKLIKELKQEIELLTGRKAVYQLALDRLEMANEELQKEVDFLKIREAGFEERLKVASEKEVEAIEMANESAEESLLRQEAYDRLGKKFEEVCQKLTVEEEQNKRWEQEMGRLQEEYNGLKREYRELQKAIPSKPQLTATIKVDTKEIQEMLDNALQEIKEGYSPRLQEEPEYTYWIKSEGSSEKHFVSDSPQQLLRKANVFYMPYKAGILTLSESLIEMVTRKKA

SEQ ID NO: 31 - protein, 167 aa, Unknown
  Description of Unknown: Undetermined Phage F168/08 polypeptide
LEGEWKVVNGFSNYSITKTGKVVNNLTGKILKPFINDRGYAEIGLGDGNIKRLHRVLLSTYNPIEGWEELTVNHMDGNKLNNNLDNLEWLTHEDNLKHYYDNNKRILVFDDATGEVLEEVTRMEKASTKYGVPKGVIQELCDLYHEGIYAHENGYGFCRMEDFGLDG

SEQ ID NO: 32 - protein, 37 aa, Unknown
  Description of Unknown: Undetermined Phage F168/08 polypeptide
VLKNKVYAGHVWSYTGREFEKGSPLASKKPIKKVFGG

SEQ ID NO: 33 - protein, 55 aa, Unknown
  Description of Unknown: Undetermined Phage F168/08 polypeptide
MLIEEDLGGFLVKLIKEVKSVDVETGLETVYRSAYAASKDLGKYSTSVRNACAKK

SEQ ID NO: 34 - protein, 71 aa, Unknown
  Description of Unknown: Undetermined Phage F168/08 polypeptide
MKLIDATVVLNYIEKTKNELNTTSPANNSKFGKGWDAGFIRGIESIKGLVKDIIIEDEIPLANPSDMIPKK

SEQ ID NO: 35 - protein, 107 aa, Unknown
  Description of Unknown: Undetermined Phage F168/08 polypeptide
LEYPEDDYDEGYQDAVETCMDEIKAALSVAKEEDSPEPIKLAVDGNIVAESFTGSSVTPINTLPNNYTKDVLEALLEASEDFYDASEIQALLKGAIQAIPKGKGVIL

SEQ ID NO: 36 - protein, 88 aa, Unknown
  Description of Unknown: Undetermined Phage F168/08 polypeptide
MGMNRIKVYTKDACAACKMTKRVLTEAGVSFDEVFVDVRNDTETVEMLRLVGFRSFPVVMLDEDFDTAISGFHPPRLKVFIETVKEEA

SEQ ID NO: 37 - protein, 69 aa, Unknown
  Description of Unknown: Undetermined Phage F168/08 polypeptide
VLYGKKEDLNEEIYSLEREIEDLEGQVYDLENELGSSEETVEELTEEVDTLSERVEELEEIIESMEEWE

SEQ ID NO: 38 - protein, 73 aa, Unknown
  Description of Unknown: Undetermined Phage F168/08 polypeptide
MSKLPFEKELKEACSKPTLTQRETALIELVGKLQNALVDSNWDKLIAEQELEYAEERLTSVVWEKRRLERGDL

SEQ ID NO: 39 - protein, 17 aa, Unknown
  Description of Unknown: Undetermined Phage F168/08 peptide
MQEITVEEFKQEEIGEF

SEQ ID NO: 40 - protein, 91 aa, Unknown
  Description of Unknown: Undetermined Phage F168/08 polypeptide
MEGIELDNYYNFLEIGYLEGDQANVETTVYNLTGMLSAKVSDVTESEFEAAVEEVTEAIDNLTNSLEVLSELFTEAKQYLAKEDKKWEDNV

SEQ ID NO: 41 - protein, 103 aa, Unknown
  Description of Unknown: Undetermined Phage F168/08 polypeptide
MRAIKMYSIKSYQQYLEKLGTVRKAAADFELNNSFSKKAHELIANQYAEDIEKLSQKVQEYHELIENIVSDEAEEDEKQLMEYLGTIRKQQKITEELESGGKE

SEQ ID NO: 42 - protein, 255 aa, Unknown
  Description of Unknown: Undetermined Phage F168/08 polypeptide
MVRIGNRELEERQRKYLTTSKEPDEYEGVDLTTLKPKMKRFARHYMQTMNIAESCRSVGYNESSGYRVLKREDVKAYLQWLVSENADAAIMSPTQVLEELTNIALRNSSDYTVTVKGDVVEKPIDTSVQLSALNSLAKFHDLLAPDVKVEQSLNIVVDIADDVPNEAEEVEEEEFVEGDFTEVEEEDSDVSYDFLSGFLRKEIPMPFEESNLEVIVNDLIKDVNTHANQIASIQSDLNRMTTDISSVRDLLIKKH

SEQ ID NO: 43 - protein, 58 aa, Unknown
  Description of Unknown: Undetermined Phage F168/08 polypeptide
MLKLLTEERRRQTESYLADEASDRKNKEFSQKQMWAVATALVTGVGSALVTIVKLIMS

SEQ ID NO: 44 - protein, 82 aa, Unknown
  Description of Unknown: Undetermined Phage F168/08 polypeptide
MDVVISIAVVLGGVTTGLVNLVKSMDVVSPKYLPLVSLAIGMVFGLAMSPLLGITLYVGAISGLVAGLSAMGFYELTKTPAE

SEQ ID NO: 45 - protein, 253 aa, Unknown
  Description of Unknown: Undetermined Phage F168/08 polypeptide
MKPIYHTCTTSLKDNIEQWYFYGGAGSGKSKFVVQNAILKGLSERRKFLVLRKVDNTIRDSIFQEFLVCLEEWNLLDFCEVKASYMTIKLPNKTEYIFKGLEDPERIKSIQGLTDIIMEEATEFTREDYDQLQTRLRHPTARHQQVFVMYNPASKDNWVYQYFHNPATKRPKGSKVICTTYKDNRFLPKAYLDHLQDLKNTNPVYYEIYALGKFASLGKRIYTNWKIDSEFKPNQLVKQGYEPRFGLDFGLSM

SEQ ID NO: 46 - protein, 129 aa, Unknown
  Description of Unknown: Undetermined Phage F168/08 polypeptide
MIAPEIFDVIKRKKLTNQLIYADSANLETIEQIKRLGARKIKPVKKGRNTVLHGIQYLQGYTIYVHPRCVHTIKELENYEWKPAKGSDDYENKPKQNGFDHCMDALRYAVNDLIPRNRIRTINKSVLGL

SEQ ID NO: 47 - protein, 511 aa, Unknown
  Description of Unknown: Undetermined Phage F168/08 polypeptide
MAIPNGQINAGDIITTNIRRKHFIRRNYDIRELVTLAEMHSRSSSAYGVLYDYYKGNHIAIQSRTFDDTNKPNSKIVHNFPKLLVDTSTAYLAGEPITESGDEKTIKAMQPVMKENYVTDVNSEEIKLSGIFGHCFEIHWIDRNNKHRFKAVSPMNCLIAYSADLDEEPLAAIYYNTVISDITGHVIRTYEIYTEDKILKFSTDDERDVYKEIPEVLDIRGYEEHPNLLKKFPVLEIIANEERLGDFEAQLSLIDAYNLAVSDSVNDIAYWNDAYLWLQGFDLSADSDSISNMKNDRVIVTDDTGNVKFITKDVNDKHIENIKNRAKLDIFSLSQTPDLVSKDFTAASGQALKAATQPLENKSAVKESKFRKVLAKRYELICSYLELMSKEKDLKPNEVTPVFVRNLPQSYAELADMAVKLRDMLPDETIINQFPWITDARLEVEKADEQRQKRADIALQNFKQTSAVQGASTAAANKLDKNPANTSTITTTDPVAAKEQEKAIQKKPKTD

SEQ ID NO: 48 - protein, 251 aa, Unknown
  Description of Unknown: Undetermined Phage F168/08 polypeptide
MARKKDKEKRQQEIEDALVALMTAQNHKYHRFTDRFTVLLDGFVNELIVNLADPKLDAFAILQVSQYEAIRKLQAALIDYQEEFREMLLESMSDTLEETLGQLFPNKAIPSATDNAYIEQVIAEAYDYFEEIFLQLLVEIEAIAVGTIPSTEDIVTTIQKLRDRLSYTLRRHIEAQMSAVINLAVIEASKQYEIELWKWCIRPELTESGTCADCRELAEGGIGNEGLYTLATMPLLPRHPHCVCILIPYVL

SEQ ID NO: 49 - protein, 111 aa, Unknown
  Description of Unknown: Undetermined Phage F168/08 polypeptide
MNPEEQGQGQQVDLTPEVIVGAIESNPELAQAIQPHVLTKDAVSSFLKTDEGLGVVAPMIDQSVSKGINAWKEKNLENIVQERLAELNPAETPEQKQLKQMQAQMAAIQKR

SEQ ID NO: 50 - protein, 109 aa, Unknown
  Description of Unknown: Undetermined Phage F168/08 polypeptide
MLEMRGVAQEALAKAGLPASLAGYVLSDNPEAVKHKVSELDIEIQNIVSGLVDQKVAGIAAKAAPTNSDDMSSIGGSKTVERLTDLTVEEATELARTNPAKYRQLVQRG

SEQ ID NO: 51 - protein, 87 aa, Unknown
  Description of Unknown: Undetermined Phage F168/08 polypeptide
MAHEVTKIADLINPEVIGAFLHQKMLDNLVLAPFAEIDRTLQGRPGDTLTLPQWNFIGLAEDLAEGEELQSVKLTAEDRKATVKKGC

SEQ ID NO: 52 - protein, 155 aa, Unknown
  Description of Unknown: Undetermined Phage F168/08 polypeptide
MAIAGKIDNDLFAAMRALTPSDVEITDSYEWVLDAQVAFGEEFDEETYLFISPKRRATILKSKDFVHIQQGVSVIKGHLGEIYGMNIVVSNKIGENEAFVLKRGALTLLMKRDYMVEEVREGMKRQTNITADQHYVAFVKDAKRAIFINKVAAGK

SEQ ID NO: 53 - protein, 145 aa, Unknown
  Description of Unknown: Undetermined Phage F168/08 polypeptide
MAKTYNIYQDEVKVQEGVAELTKTITGLTPNTSYKFEVTAVEEGVESAKSTAVTAKTNPRKVATVTASQKTMSLASDGSKALTFTVAPEDATNKELEITNSNPEFATYADGTVTAVVAGTTTITATAKDGSGATANCVVTVQAPA

SEQ ID NO: 54 - protein, 134 aa, Unknown
  Description of Unknown: Undetermined Phage F168/08 polypeptide
MELIENTELFKSFEDVTLPPETEAIDITDLKLMLGYGNSTIRDNVLKVLKKRARQHICLFINKEVTDFPMELDYIADELTASRMSQLNSEGLKTESTDITRYDYKDDIYANWYGILNRWLEQQGEYRNKAFFML

SEQ ID NO: 55 - protein, 125 aa, Unknown
  Description of Unknown: Undetermined Phage F168/08 polypeptide
MRYNDIVDLIQFNDWEDPDDDYGTISYKTRGTIVVKDLPVSVGSLRVQGKLLQNQDQQWEKRYLIQHKVFELKNLRVDAVRRHSTGEILNVYWDNTTGTDQTVSYKVEYRDIRRDKEDGVIWQGS

SEQ ID NO: 56 - protein, 126 aa, Unknown
  Description of Unknown: Undetermined Phage F168/08 polypeptide
MAGFLEITKRIDFAGLEREFVNEVKGVVEKNSAQMATAVRLNIVRRGNIDTGTYYDGIKSKTEVEGKGKSVTGIVESDVSGNPYGHRGYAVYLEEGTYRHQAFPNFTDALEEYSDILVEQLSRIKV

SEQ ID NO: 57 - protein, 143 aa, Unknown
  Description of Unknown: Undetermined Phage F168/08 polypeptide
MSNRPPFRARSSSVALQRAIVKEIRAQGINVWDGTNKFPEYPFIKIGEELTSGRTISKDAIGKMHNLTLHIWSDYDSSFEVKSLTDFLVDLLINSPLNLEDGFCIGEKSLDHVRYTEAANGTYKNERAYLFLDFEVIDSTIEP

SEQ ID NO: 58 - protein, 229 aa, Unknown
  Description of Unknown: Undetermined Phage F168/08 polypeptide
MEACKSSYIRGTAVLIEVQNDLGEWIKVAAQRGGTLNRTAATLDVSNKEGFGWDDAEAGNKSWSIDCDGLFVEDNAGFQALNAAWVNGDCVRVRVKFPSGLTYVGQAILTDFPYEFGYEDAVTYSLTFQGKGALEEQQVAPTILPKKVEFTNETKEVKVGETLQATIKFTPENVSDQSVTYTALTPALATIDESGLITGVKEGTASFNVRSNVNTAVSALIDIEVKPAG

SEQ ID NO: 59 - protein, 121 aa, Unknown
  Description of Unknown: Undetermined Phage F168/08 polypeptide
MIIRFQGKDLNLRLTYKSIHFLELAFDQDYASFIAEQTPFNQSLYIFWAMLQNESDYEGVSVLDVAELLQDSLDSYEFTLEEYFEKVNSSYASSILVKQLFKKQHWLVTQRRRKTRTSFRS

SEQ ID NO: 60 - protein, 98 aa, Unknown
  Description of Unknown: Undetermined Phage F168/08 polypeptide
MVLCSDLGIPSSDFWTSTPYEFNGMLRGAYQRQSREASLFLSLVQSKKPVKLEKYQGFELVNETNKPKTTRDMAETMDELDRAAFKEEELSNLFDYFD

SEQ ID NO: 61 - protein, 544 aa, Unknown
  Description of Unknown: Undetermined Phage F168/08 polypeptide
MADKEMRIKVRVDNSDYASKMKDMEGTQSRLGKSTEQTTGIFGKFFNKLNGGASLANSSMLGLGKSFLSTSVGFGTLTAAATPMAAAVMGAAEATKVAGRFAMDSIKDYANFEGTLKQVQIIAGGTQADMDMLGDTAIEIGGKTSKGAQEVAEAMVDFAKLGFTAKETSEAMKGIVYAAEASGSGVQETAGIVATALNVWNLKATEAEHVADVLAKTANETAADMQDMGYVLQYAGSSASLAGASLEDLSAMAGIMADNGIKGSKAGTSLRTAFTNLINPTDGAAAAMESLGVQFKDAEGKARPTMDVIYDLQDAVKGMDDIQIQELSTILFGKPGAAGMSFVLKSTKEQVQDLSKALVDSTGTAAKQAAAMRETMAGQLDQLGDSVDAIKLKIGRAFTDMFALDAVKGFNKALDGVDEGLSNFGKGFKRTSDLLETSNGLISGTKDANKFVEAVRDAGTNLTNIPFQESLAQSQVWGIGISKRAYETNEVMYQLNKSIQEFSFLPDDWEGKWGQASTILKDSVGQMELKLASAAAKGKHGGRS

SEQ ID NO: 62 - protein, 428 aa, Unknown
  Description of Unknown: Undetermined Phage F168/08 polypeptide
MGGEADISGIMNQTIQENLPALQTALDEQVAVFGTANQSRLDALQTFFTNEKTLTDEQKSIMIQGELTHGQQLSDTIQTNNNKILELYQSMGQQDYAQRQETGAAINALQQQNSEILQNIATTESSSIVETLRAQASSTGTITQQMANDSIAAANQQYSETVAAASKQYVETVSSINHMSDESIAAAGTTRDELIEKARQQMVGTVDHAKTQKEQTVGEIQKIADKSEEVDGTHIQINADADTTSAMEELGQLAARINDVFRAFGETAGKIQGGIDGFESKLKQADNWIAGKVGGIFKARGGLTSGVGYGIGGGNAQYSPMATAVGVGTQLGQGGINQGVIHNERGREVTMPIQNATYMRPFAAAVANELQAMGGGLGGGGVQEVIVPLYINDREFARATNKAMTEEQQRVKRIANRAVGKKVKETFK

SEQ ID NO: 63 - protein, 1330 aa, Unknown
  Description of Unknown: Undetermined Phage F168/08 polypeptide
MTCSNKPNYTPFKLQGLAPTKQWGLGRSASYERFNPNEFHALEDEVKITFPVDFRGKVKGNSNPNPSRGFSHASQIYRENVLRGSQFLSKPSLLFNGAVYNEKTVYNGAMVASTQEVNQGLMFYWEDFINPDPRIKEGDMVTFSVDVRSTGEDIPTGAVAFKGTSNFEEYYKVLEQPITKEFTRISFTTRFLSKDWEWDEAFGMFWGAENVPVTDYPMFQYDKDKLVGFIQAQESVQLEFSRPMVSTIGKTAYIESGDDMFSNNKWDWSKAVSKGRLNEFDGKYNTNGIKQDWAMPEFIPIFKGSERIHFYKKTTLTETTDAGHGYGKILFYSAANEDSYMNVYKKFPHEAGVYGGYAAEVEVPIGATHYRVHITSERGSATTEAYVQSSANDWSEFSQEWYDGLSGKLDGKTARAETFYRKEMVEMEFELHFAEAVQKALPNIFKDLTTDAEKQQRLRDIAYQFDSTMIARGRGQGNNLADWIFYRWAPDGSIEEQTMKQFRGEGLTSVTHPSSYQEWINPQGRIVTSLRSNRIIPNSMYMGTDTLSGKYDPKLTTLQLEVNGELVDKKAALDKTSEVFTFTGLKGFLKPEDKVRIAGWNNRNNQWSITYSNVLMGNTPENIAEFNERAFVEADYLVTNMSVIVTQSQMDEWGFNPNLPDYRIESLERPASRTEEYMINSMVQVTHAYDIYGFIESNYPEFYGDCYTFDDRIRKINERIKQFNIVATTYSEEPWEDGDPTIYICAEARNPDRDYNVTSEINQTVELQINNSKGHFIHPNGYIYVGFARMPRSDRETGISVESELSFDFTMDRQYDSLPRVFRYNYQKQPWFLFVRNINRSVLAPKVNTLTPINGGTRRYNFGATEDARYISMDCFIKAPAEEDMPKLMEELADFLDVGETVIQFSDNKDRYYKVILDGSTDLSQTLHVGTLTLTFVLLENTAIGEEVVESFDIDSTTGSVPFIELENMGTADAYPTYQLTFEEPVGYVDLIGTDTSANVSIGRRPKDTEDEVKVDLRPRKFYSKFTSTDGAGWTAMNDTQLPQIEGYSTKLQGTVQRVNGMANQDKWNYGDTSHRGWHGAGIVANLQKNLDDFYMEASIVATGKPVKTSANAIFLIFYDENNNPYAYTKVGTRPQEGNLDSYVAYAGDWGKRKVVNNGAKWKDFWGKVSVQRRDNRWRLIVGQYKDRRYSPSPEASFNFGQNMLKDTRDTGWFDLPPETWGKKFARVGIFFGQYSHRPKLGHLSVRRLVVWENLEEYGEKPLEGTPILFHEGDTVVIDSSKAQAYLNGELTPSLVDPMTDWFPITKGDNYIGINNFKGKLDIVYNERFK

SEQ ID NO: 64 - protein, 198 aa, Unknown
  Description of Unknown: Undetermined Phage F168/08 polypeptide
MITVLNANGQTVAHFVNNVSEGVPYFEPTLTENIETLVSTFSFSVPLDCDESQYLKGLNKVLVKDKDGDLRQFNIIHTEEVFQEVDSRILVECEDFSISEMNDTVIYPFNGHNLGDTLTKAVKGTGWGIEYSADTWQEGEEPFILAEYTNMREVFGNIQKTYDVDFKFTAERTAFNQTKRIVKVYKKQRSSNRPLLHL

SEQ ID NO: 65 - protein, 643 aa, Unknown
  Description of Unknown: Undetermined Phage F168/08 polypeptide
VQYNTIKTAILPYYTGVDGKVWTLKGMVPVNPIEGITKDKESPLVVHNQAHADYDEPFFFKAMPFKASSTNPEQVYRQGVEELLKHIAPIYTYTVNVILLNRVQGWEGETLALGDTVWMKERVGSREIGLEARVIEYIYHEDDPSLDEVTFTNFREIDTYDTSDIAGIRDALNDLKDQVDSNTVIIETTREQISKLEEGQSGIIEDLGNKNSISIGDTPKPNPIDGDTWFSTRVNEAGQTIHEIKVWDGVEKVWKLSMDTSKAFEAEDTAKAAQKDAEESLDKANQAVADADTAKTAAQEALDRYNNLMISGRNLALNSQKITVPDVVAGTTTRRKTIPLSIPTKLGTEYKLKFKYKLTEGTLPEGITVGIYNVPKLAWASNIVTIPTEGKDEGELFAELTTNATEGDVLLIYQGVRSAVKNDDNFDFTEVYLVEGDKIGDWQPAPEDAIASITNINGEITSLVTKTDGLETSYSQISQTVDEIQFTVGDKADKSQITQLQDQINLRVEKDDVINQINVSTEGIIIDGAKVQITGKTYIEDAVITDAMISGLSATKLTAGVIDASKINVTNIDASQIKAGTIQGIDIIGSKITNPFEIGSEGYTLAGQTVMERAQVKIDYSVSETGQKRLVNTSCKRYSKSAT

SEQ ID NO: 66 - protein, 183 aa, Unknown
  Description of Unknown: Undetermined Phage F168/08 polypeptide
LTTAFQKLVKKGWSILHARGIQNQLLNLDGTINSFSSLASDGLSIQDSLGNSGYLSAELLMQFSNTGKKIYPGNSWVTNTDRIVPSLTMNKCAIGWLFLWQPYDTTGGKPYTWDYTYYLVPKAHANFNSGKGINMRLQGAGKGGGADDTVYKYVYVSNDSITGTVNNGTGNGAKWVLTGVFSV

SEQ ID NO: 67 - protein, 95 aa, Unknown
  Description of Unknown: Undetermined Phage F168/08 polypeptide
LRVWIEDKVGLLTGYSTEPLEGYKCVNIDPSESLEMLGGMLDFHNYYYDGEKVYRDTNNDFQKFLEEEANKPPEPSKEEMEERLAKLEALLADLL

SEQ ID NO: 68 - protein, 237 aa, Unknown
  Description of Unknown: Undetermined Phage F168/08 polypeptide
MVKLNDVLSYVNGLVGKGVDADGWYGTQCMDLTVDVMQRFFGWRPYGNAIALVDQPIPAGFQRIRTTSSTQIKAGDVMIWGLGYYAQYGHTGIATEDGRADGTFVSVDQNWINPSLEVGSPAAAIHHNMDGVWGVIRPPYEAESKPKPPAPKPDKPNLGQFKGDDDIMFIYYKKTKQGSTEQWFVIGGKRIYLPTMTYVNEANDLIKRYGGNTNVTTYNYDNFGLAMMEKAYPQVKL

SEQ ID NO: 69 - protein, 100 aa, Unknown
  Description of Unknown: Undetermined Phage F168/08 polypeptide
LDVPHVYLRDTKDCSKITIGNLPTEPFEVTVSAYREPSDITVGMIPVSFIEGDFDKYYEDFASDITKRLKDMAKLKEDSHKQAVDSINKEKVAEVVMFFE

SEQ ID NO: 70 - protein, 119 aa, Unknown
  Description of Unknown: Undetermined Phage F168/08 polypeptide
MAWIRTKENKLYKDADGNKVDTKDWKNAPLSMWNTTTFMEYVAYLNQQKFGKVPINASLQTLRAIMKKDIERFGAEALKIFLEMAIKDYHGNSRYPTLSYSQARLLYMERFMSVALEKS

SEQ ID NO: 71 - protein, 113 aa, Unknown
  Description of Unknown: Undetermined Phage F168/08 polypeptide
MSIELSQKRFLPNNFNLPCINHKDENPKNNKVSNLEWCTHKYNSNYGTAIERKTKKISKPVRATNIKSGDVIEFSSMKAAHRAGFDESTIAQCCRGVYIQHNGYVWEFIEEGI

SEQ ID NO: 72 - protein, 55 aa, Unknown
  Description of Unknown: Undetermined Phage F168/08 polypeptide
MCYDGFIKDLRRGFIMEVWKPVVGFESHYEVSSLGRIRSLDREVYSEKRLIYEIS

SEQ ID NO: 73 - protein, 274 aa, Unknown
  Description of Unknown: Undetermined Phage F168/08 polypeptide
MAKGLEAIAQAAQAQSKGSGEQSKKTYLKKGQSIRARIPEDILENLHVNQVVSVFEPQVLPTLSYHAEGRTDVRDLYHEATEIMLADHRAKVESGEIERGSQADKDSYKAARILTPKPLILFGVIPLADFTQGTKKTNTYPAGEPILLETNLGRDNANIDALTNFLSKETNAKKFPKKAFEITCEAANRYTFTPLDDEDLTPEELEVFKATEGATVPEEDFENAIFESTVERQIEDLKKIGFDTTRLPNLPTAAPSPSQGADEAGTVDPSGIDF

SEQ ID NO: 74 - protein, 143 aa, Unknown
  Description of Unknown: Undetermined Phage F168/08 polypeptide
MKKDNPQVNPIKFTEEDYFRLLQTVVMTNTFIGSLSAGYQGKERLEKITKIAENMFVLNRLMESAESNGEDWGDEMLLDSLYSDSEVLVTKYKHLLSEAQLESINNSIKNFAESAEKARKEAYEEKVAQAEVIDFKKGQEEAR

SEQ ID NO: 75 - protein, 86 aa, Unknown
  Description of Unknown: Undetermined Phage F168/08 polypeptide
MLKEAVSESLWNAAYEILHTTMATADKVIALVTVYNASNLEESTYAYEAIQDSVNKAICGGAVEDVKWKQFVGSLDSDYKEFFEKV

SEQ ID NO: 76 - protein, 66 aa, Unknown
  Description of Unknown: Undetermined Phage F168/08 polypeptide
MDYSKFKIGDTVMYQGQLCGAGTVINGNTYTVVQLTSKPRYAFIIDEHGNKKLIQMGFNFAKIKEA

SEQ ID NO: 77 - RNA, 71 nt, Unknown
  Description of Unknown: Undetermined Phage F168/08
gcguuguaaguguaacggcugcacaauggucuccaaaaccauuagagaagguucgacuccuucacagcgug

SEQ ID NO: 78 - RNA, 87 nt, Unknown
  Description of Unknown: Undetermined Phage F168/08
cggggaguaucauaauuggaaaagcuucggucuugaaaaccgauaggcguguaaaagcguuuggggguucgagucccuccuccucgg

SEQ ID NO: 79 - protein, 41 aa, Unknown
  Description of Unknown: Undetermined Phage F168/08 polypeptide
MNVESRNSEKAWNRAIVKAEQEAAKKKMERLAKMRAKSKRK

SEQ ID NO: 80 - protein, 41 aa, Unknown
  Description of Unknown: Undetermined Phage F168/08 polypeptide
MKDTVTISKSEYERLLKAEAFLEALEEAGVDNWEGYAMAFF

SEQ ID NO: 81 - protein, 66 aa, Unknown
  Description of Unknown: Undetermined Phage F168/08 polypeptide
MILRIGFFWRSNSESLHCKSIEYIDMFQCGEEGYYKVVFKINEYTYEEHLPDSAYTAITLINKEEE

SEQ ID NO: 82 - protein, 70 aa, Unknown
  Description of Unknown: Undetermined Phage F168/08 polypeptide
MNLGQLLDTVEYGTRVRLVYYKSTYNSDEYITTFVMSDTLEYTKAYELVEPHIEKRSNYNLCYSRWKIMC

SEQ ID NO: 83 - protein, 44 aa, Unknown
  Description of Unknown: Undetermined Phage F168/08 polypeptide
VETMYTVIYKNAVESEPALEGGSFLTDAPKTDGLKLMTFGTRVF

SEQ ID NO: 84 - protein, 72 aa, Unknown
  Description of Unknown: Undetermined Phage F168/08 polypeptide
VWNQWTLYWTDRETGEEGNFKIPRPNALFIGMPIDIDEYRYTVTAVSTPTKEVWTERIPFDFGTKPPWEHNN

SEQ ID NO: 85 - protein, 314 aa, Unknown
  Description of Unknown: Undetermined Phage F168/08 polypeptide
MLDTIHLTKDIQIHIDIQEYLERFEWNRAKWTEDRLIAASPFRDDNHPSFFVNYNNDWAGTWGDSGTGDSGNFIQLVAELHETDYETALEMLKEEFWIKPYEAPAISVKLSVKKEKSIFDIPTHNTSKYLLGRGISKDTQKLYRTSEDESKVCLPYINGMGLATALKYRRTDNKDFFYEAGNNHLKNMLFGYHVIYEKLPNTLVICEAEIDAMTAYEMGFVGISLGAANLIERQVDLIKKVDVKNIIIGTDNDEKGNLAAKSIDDAFWKTHKLFRYDMPSGYDLNLYWQEFHKAPPLKKISEPKLLRRKLWYIQ

SEQ ID NO: 86 - protein, 77 aa, Unknown
  Description of Unknown: Undetermined Phage F168/08 polypeptide
VAEFLGRTPESVKAKYYELRKQGLLEYPSSINKKWTEEERQYVLDNYGKISNKEMARKLGVKTSQLIQLKWYHTHKK

SEQ ID NO: 87 - protein, 103 aa, Unknown
  Description of Unknown: Undetermined Phage F168/08 polypeptide
MRKQTLLEKLKQVTGKTEKELNPTLSHIHIQLCGGSGTGGKFGAAKVPYDYSDNFLFNSPARDTQKDVYKQLEVYVESFKRDFQKDGNINQDERPIKKYLSME

SEQ ID NO: 88 - protein, 156 aa, Unknown
  Description of Unknown: Undetermined Phage F168/08 polypeptide
VKIKVMEKTSTAAALLNEYMFMSWQASVILKTNMKQPPAYFLDVNSFQTLYNKFTRNGIAKDIAEKTSREYYEMMELAETAPLVVFDEIGNRSATEAFRADLHDIINKRMVNKLPSIFTSNHPIEYLEQVFDERLADRVRERTMVYNFKGESHRGL

SEQ ID NO: 89 - protein, 377 aa, Unknown
  Description of Unknown: Undetermined Phage F168/08 polypeptide
MASITAEMLLSKVINENDVQALNRHGVSEDLFQSPIHKDAYNFIIKFSRENEGNAPSYQTLLQKVPELDYQSSTEESFTSLTKSLKNSRLQVDTAAFINKDLGEFWENSVKSDDPTEFINQTIAALEQIKAEHNVGGASGRRLEKASEWYLEEFYKRKEGLSVKFWDSHFESLTELIGGGYQSGNVYTWYGRSGRGKSTITLVEAIEAAVQGANVLMWVLEMPKYEFASRAISFISARDEVKKSRINGSDYLAGFNIANLTQATFDTAEEEQDFVDFINSLNDKLEGSITIRAVDDEDFMNRSLKQLERDIVENGADVVVIDPFYYLHYEKNTSKTAGGDASQTSKALRLLAGRTKTVIHAITQAEEDSNEKRRRRA

SEQ ID NO: 90 - protein, 64 aa, Unknown
  Description of Unknown: Undetermined Phage F168/08 polypeptide
MSLLEDAAYVLAFDSCDSRFAVEVVKGRSGNEGKQVEGIFLPVIGYVEESSDEAVTDVFEGIEF

SEQ ID NO: 91 - protein, 165 aa, Unknown
  Description of Unknown: Undetermined Phage F168/08 polypeptide
MIIWSLFDSGNGCYSQVFSEKEGVENYSIGMDKEKGTSKNHLNLDLADMSGYFGESNMIKSLENLPKPDVIIASPPCESWSVASAMAGGNACWNHLKGDPFTIRTSKEYESVQFNHENSFYNRMNGELTVFNLIKIIKHFQPKIYIIENPAFGKIWEYIDKVLGF

SEQ ID NO: 92 - protein, 60 aa, Unknown
  Description of Unknown: Undetermined Phage F168/08 polypeptide
FEIKKPTKFKSNINLNLKSENVKAGTEFRKASRIGGSYNVRSNIPLTLIDEIYKRIEEEL

SEQ ID NO: 93 - protein, 74 aa, Unknown
  Description of Unknown: Undetermined Phage F168/08 polypeptide
MSFYLSQMNNLKEKIRYEKTSVKLIRESIERIGKPTGEYSLGYTDALKMELLIHQKMLEDAQKELLDLEKERNK

SEQ ID NO: 94 - protein, 34 aa, Unknown
  Description of Unknown: Undetermined Phage F168/08 polypeptide
MTATKELWKPLVFKGIHSDIYEVSSEGLVKKQVD

SEQ ID NO: 95 - protein, 118 aa, Unknown
  Description of Unknown: Undetermined Phage F168/08 polypeptide
LTDKLLKPQDSGYLHVRIPLEGKYYNARIHRIVAETFCERPAGCNVVNHINGDKKDNRASNLEWITQRDNVIHSIKLREEESKHLSMIEKMDMLLEKLIPSPEAKYNFMEEYVEWLKG

SEQ ID NO: 96 - protein, 342 aa, Unknown
  Description of Unknown: Undetermined Phage F168/08 polypeptide
MAKGLTAINKAAGKTLVDTIAEDFKRQLNKWGETGYTYDSEVHHQLMRDYLKIVDRNPFEDFPENVPVFRSSGTGKCLREQTLFAIDKIEGSDRKDPPKMQAHQSRWVQIGTKVGDMIQEQVLMMEKNYRRFTGEDCHFRFERTEEGFPHFEEFSTTFKKYKSGRMEFITGGSMDGIMIWTDPSSGEEFRVGLEVKSKQTTPAATSAFSMRQPNSKHVWQVKNYAMLKDLDLYLIVYVNCAHKSWEMAEEDYAKNPDLQVFGVNITEQDKKDVRNRFFTAIEHAHAGTLPPLELSGFTFSDYKYALANSLTYKELEELEKKAVSKFDQKALEEIKKIRGDVK

SEQ ID NO: 97 - protein, 109 aa, Unknown
  Description of Unknown: Undetermined Phage F168/08 polypeptide
MNESIYEGIPEDILQEKFYGVFIKFRCDNRTKPLAMHISELSKEMLDATYLQREAGESNIILKDVNTGLEMAFDLTDIVVYSTKEIALGDTEAYYSFAEHMADMMLGDD

SEQ ID NO: 98 - protein, 192 aa, Unknown
  Description of Unknown: Undetermined Phage F168/08 polypeptide
MIKIRFISFDVSSVSTGVAVIDREPSGYLTLVHTDIISTNPKHNVGRRLKNFAEAVQILLETFRPDYVVKEQTIARMATQHILLKFAGVLEMIASNEGFPKIYEYSPTTVKKVVGGHGRATKEAVLMGTTEYINWNEPIDLVIDDISDAVAICLTHIGKEFVLVPLGEVEKAKEEAMIVEAEASKYLEEATE

SEQ ID NO: 99 - protein, 189 aa, Unknown
  Description of Unknown: Undetermined Phage F168/08 polypeptide
MKQQLRIAITGTSRSGKDTFAQAIQKKLVEMGFAEAMPIAFADPLKQLYKRYFFYMEDKEKPRDAYVTIGNAMREVNENVWINNLLIQAAKDWDEGFSTLVTDVRFENEAKTLINDYGFILVKVDADPLIRLVRAEALGETLDLNNKGDIEVGMIEPHLTFINNGESDLMQMDKYAEIIINMAQEVANG

SEQ ID NO: 100 - protein, 50 aa, Unknown
  Description of Unknown: Undetermined Phage F168/08 polypeptide
MANLLISEKSYYEKLVEAETANEFRMVLIRLINRVVMKVKVPLEVRELFL

SEQ ID NO: 101 - protein, 163 aa, Unknown
  Description of Unknown: Undetermined Phage F168/08 polypeptide
MYYERFGDVALPDSLANILSTYYMQDDTRGDLEGTNKFARCSKMEYSFASDKKEKRIRTEDLYKESPINLEVLEGNGYSRNNIASSLDMERAALRTDLLKAMAKADLTEMEKKVLELNLIYDYTMREIEVLPEMPSRSTLSRHLTSARKKDYATNLKYFQKGA

SEQ ID NO: 102 - protein, 161 aa, Unknown
  Description of Unknown: Undetermined Phage F168/08 polypeptide
MPRTNNKISRKKALEVYLEGSNPLAAISELIEEHTWTVGFDMESATFYKERTSNPYDTCKNPRCKLCKQIREHAERIPAYSLGKTLAKPFEELSLGHFGKLAANDVAKSDMPKLLKVSMKDINNHIEMLVEKNWIRQFHQPSKRLRVIRTSYPTAFRDWCL

SEQ ID NO: 103 - protein, 25 aa, Unknown
  Description of Unknown: Undetermined Phage F168/08 peptide
MRQFKKRMYEGKKQRIAEAKKGEWA

SEQ ID NO: 104 - protein, 36 aa, Unknown
  Description of Unknown: Undetermined Phage F168/08 polypeptide
MKQYIKIGAAILILLIGVAVWLIEFILPFVLLKWAL

SEQ ID NO: 105 - protein, 64 aa, Unknown
  Description of Unknown: Undetermined Phage F168/08 polypeptide
MGLLERITYSLFIALVVVLAVGAFFVGVYWLAVWTSGLGGLGTFVAVGIVMFVFTALAVFLGFD

SEQ ID NO: 106 - protein, 143 aa, Unknown
  Description of Unknown: Undetermined Phage F168/08 polypeptide
MKLKDLLEVVDPMQDISLEIAELTAPEGIYAKDIQKLRPMAVEMEVVDVHTAWYSGEDSIETTLGVVVTGGVKVMRKLFEENFTIDEMSEMWYGWDNEGLLYGWENGEAGEVYNILEENGYNMDSIKIMYGAFVTLGELVGAI

SEQ ID NO: 107 - protein, 125 aa, Unknown
  Description of Unknown: Undetermined Phage F168/08 polypeptide
MSLGMFDKELLAALAALRWVVEDPEIKERHDEILNTAYMENAYEKGDSFPDEKFVEWDFINALTTFEIEAAARGLITDDEAYDEEDDMDWASDTYSCGCCTCCGCTCDYYMWEDDGSFDEDDLED

SEQ ID NO: 108 - protein, 61 aa, Unknown
  Description of Unknown: Undetermined Phage F168/08 polypeptide
MANYYVLKRLDDGSGKLHQVKCYKSLDKAIKYAKEMSTFKKTYQVAGQFDMNRLANTGRLI

SEQ ID NO: 109 - protein, 415 aa, Unknown
  Description of Unknown: Undetermined Phage F168/08 polypeptide
MKNSAKDKERLKLVKEYLEEGKVSREEDKLNKNFSKAEALRIYQKVQEMEREAKFDEIRKKEWKKFPIINNIVELASWIDNALECDNEYLAMDFETVGDNGGTDMYREEISGFSLTYRYKGEIINGYVPMRHREEDGSPSHLNIANVKWAEEGIKRVFESDKATVWHNATFDMGLAKASLGIAPRTPVHDTLILMHLLDEDLPSYQLKVLATRFLNIPSDTFEEMFGKNAKFADIAVEIARWYAGKDTYVGFLLFEWQLNILNKPSFAKIKKVYERIERPCIMATFEMESEGFHINMEEVEVQRKESEAELEEISARLQARFGDVNFSSPSQLLKLLYVDNDWSKYVTPDHKSILRGHVGYNEHGISNNKLFALMPNGSVILDPVVNAEGKVVPKNDRNKLQANAKAMKKDCQSC

SEQ ID NO: 110 - protein, 200 aa, Unknown
  Description of Unknown: Undetermined Phage F168/08 polypeptide
LTAFVNKIDTFIAPDGKLHGQFNQFGTVTGRFSASNPNLQQQPKKARKMFEAPEGSLILGADFSQQEPRLLAHSSGCQELINIYNEGRDLYSEMASAIFNKPIEECLDGSIYRKNTKMIVLAIMYGMGAYSLADILRIDAQEAQKMIDDFFVVYPEVEAWIEGNKKTVVKQRYVETLFGMRRRFKHENFDILKKELELLR

SEQ ID NO: 111 - protein, 130 aa, Unknown
  Description of Unknown: Undetermined Phage F168/08 polypeptide
MKTSTSLKKNWNSLDENDKKLRSAASRALRQATNALIQGGAASQTKLVMNAARIRLKELSEARGEPNSFGFLAQVHDELLFKVPENVTQQEVDAIEDVMINTVKLVVPSKTDIEIGKNWGKMTARKDWFK

SEQ ID NO: 112 - protein, 93 aa, Unknown
  Description of Unknown: Undetermined Phage F168/08 polypeptide
MNSLYEQFKEGTLKEGQRFSVTGTIVLIDAEDPALPLKVDIDGEGIKWLKEGAIKYMEPAAEKLYEVSIGGRLLSYYGSDYEEGKWTCFFVEK

SEQ ID NO: 113 - protein, 53 aa, Unknown
  Description of Unknown: Undetermined Phage F168/08 polypeptide
MKKGNGHAFLWRSREEPKDIFVQAFPMSFLEKHFPEVVEIAKESNKEEGGNAL

SEQ ID NO: 114 - protein, 130 aa, Unknown
  Description of Unknown: Undetermined Phage F168/08 polypeptide
MKRFAIITRIEECTPDEDLLELGKAYEIVNELVGGAHVYVDERHKRYFVDSHQYVEVAEGIFELTLGMLLSKLDEDINTNLEISFEGRATKIVSENYYKDELKDYFDREVKWYSPDTVVDGLSILLEGGV

SEQ ID NO: 115 - protein, 71 aa, Unknown
  Description of Unknown: Undetermined Phage F168/08 polypeptide
MEIKVEQPKEILLEVGWRYTSDWIVNSTTVSVEDNVYAYENACYKVLEELCESIDAKYIDICFVREATENA

SEQ ID NO: 116 - protein, 153 aa, Unknown
  Description of Unknown: Undetermined Phage F168/08 polypeptide
MPKKYYLKAISMYILYAFIAAVIIGGTFLLVGAFVWVGKYVYGRFGDTVGTILFLSTAGLIALCTALYYEARKEFRKDALRVRIQDPEDGINTQSHKIVYMLPEDVIRQASTIVGIIPKDIQHIESEELRKKGSPCHHEVFTSGVWIYAYHRV

SEQ ID NO: 117 - protein, 39 aa, Unknown
  Description of Unknown: Undetermined Phage F168/08 polypeptide
MLREIWDLNYTFKTRGKLMEKLIDRGVGLDGEFLKYLVD

SEQ ID NO: 118 - protein, 92 aa, Unknown
  Description of Unknown: Undetermined Phage F168/08 polypeptide
MNYEEFKKEIESIDYLSVENRYDRVLVYSSLGDYPLVAVSILETGFVDYNWRGHVRARDIPVLTEAVEKFAETPYEERFPKKLLPTYWRKLC

SEQ ID NO: 119 - protein, 74 aa, Unknown
  Description of Unknown: Undetermined Phage F168/08 polypeptide
MRSVFQKNYYLLIGENYVSGITFTYPWLSADCEPEEPIEVTFNEAFPHLFTNRNKEQASKMLDAAKIKHTWEVV

SEQ ID NO: 120 - protein, 72 aa, Unknown
  Description of Unknown: Undetermined Phage F168/08 polypeptide
VLLTELALIFWEEGSVHEVIKRNGTLIIDDDDTLGRGIRNSDDILSYLNLEYPVKNGSSGGRHHEKHWGTHN

SEQ ID NO: 121 - protein, 97 aa, Unknown
  Description of Unknown: Undetermined Phage F168/08 polypeptide
MEVVEEGIMKSTGERITRDNIKEGMKVVCVKSIYESQGYFTVGKEYEVVMGNCGYLGIKDNGRDGFIWDCAIFNEDKFVFEILEEPSEKSFFKSFRK

SEQ ID NO: 122 - protein, 81 aa, Unknown
  Description of Unknown: Undetermined Phage F168/08 polypeptide
MAVMDLSGIVQSLMKTSLSSRFWKSLQKKASLKALESKIRELNNHQQELFQKRDRINKQAIQLGSKARRLEEAKALIEKYI

SEQ ID NO: 123 - protein, 41 aa, Unknown
  Description of Unknown: Undetermined Phage F168/08 polypeptide
LWKALKKELSEQLSEDLTPADITVLNIIPMDKKQSSLITGI

SEQ ID NO: 124 - protein, 136 aa, Unknown
  Description of Unknown: Undetermined Phage F168/08 polypeptide
MLTTDFIKAVEKIGLEVDNSYSSVLYVESHDGVVVSINKGCSETFTWCNGTDIHVGSLLELIPLVEEYANTPIGEREKKVSEKPLESYPIEELGEAISKILLNKHNPNAQVVISQERIHFYEPKWSTPSEWALENL

SEQ ID NO: 125 - protein, 62 aa, Unknown
  Description of Unknown: Undetermined Phage F168/08 polypeptide
MEDLFKFACTLVLMTVLISGYVAIQLVIIAVAGTFLPTWAFVIVLGWLVYTNYRVLLKGGEY

SEQ ID NO: 126 - protein, 61 aa, Unknown
  Description of Unknown: Undetermined Phage F168/08 polypeptide
VNTVYQDTQDIYLKAFWICIDRARNRAGVTWTYLQGGDTPRAINGTANPSIKKDFAAYGQA

SEQ ID NO: 127 - protein, 70 aa, Unknown
  Description of Unknown: Undetermined Phage F168/08 polypeptide
MNILNGSEMSRLIYMVECQLADVKCNLAFYQQDSISGSPGIIESLTEDLTELTRIKARLEVMLEQFEKLV

SEQ ID NO: 128 - protein, 71 aa, Unknown
  Description of Unknown: Undetermined Phage F168/08 polypeptide
MDLTAEELTFLACLVENNNEEVQDSINIYKSFDKDAAAKVLEKQLLESIRLASRLREESKKSMLIGGLSIC

SEQ ID NO: 129 - protein, 63 aa, Unknown
  Description of Unknown: Undetermined Phage F168/08 polypeptide
MLIKKEKKAYLFTIYGLHSYPSVIGVDSYSDSVAMERFYKIWRKHYPKHYKTHKEFTVKKFDI

SEQ ID NO: 130 - protein, 46 aa, Unknown
  Description of Unknown: Undetermined Phage F168/08 polypeptide
MIPEGTYLKDSSGLNHYFIEGHIVGVRTGVRGYQTVVWDKELDKNV

SEQ ID NO: 131 - protein, 17 aa, Unknown
  Description of Unknown: Undetermined Phage F170/08 peptide
MKKRLEELTPDELQQYA

SEQ ID NO: 132 - protein, 153 aa, Unknown
  Description of Unknown: Undetermined Phage F170/08 polypeptide
MEDKDYALALEEDTGVWKACETFPTREEAVSAGKLALLSINEGKTYVDSLGMHVEDIFGALPEKGATSFAVGQFNKAVISVDVVGMLESVGEQLYSEYGEVAEDYYPTDEVSDEAIDELHDIIANWLNKNLTQPPSFGSVDDVEKITLEGENK

SEQ ID NO: 133 - protein, 58 aa, Unknown
  Description of Unknown: Undetermined Phage F170/08 polypeptide
MNNLTAQDLLDELLELKDQGHALEDYIVVGEPINPYDHYLEFDGWHLDSNTNMIILKG

SEQ ID NO: 134 - protein, 64 aa, Unknown
  Description of Unknown: Undetermined Phage F170/08 polypeptide
MNVLKQYIKEVHSVTPYTEDWTKHDKGFLMVDLTVNCYGSLSRREHLFYVDEWEEAKKKGYYMA

SEQ ID NO: 135 - protein, 145 aa, Unknown
  Description of Unknown: Undetermined Phage F170/08 polypeptide
VRDEKEVNYFIETLAEERKKKWNGYLTSLRDSVTLREIRTSYSVMTGAYIVFLYIYNYDLNKRTIVKATLDDWRMPYVDLGEFEYFRELGKMYDDKVREALDLYVRQIGRSRPESKALGIRRYKEVSRNNRTQTRKFKPRKGHVK

SEQ ID NO: 136 - protein, 227 aa, Unknown
  Description of Unknown: Undetermined Phage F170/08 polypeptide
MLLNKHWNSDEEDLILLGDYVDRGSKSAEVLGFVYKHILNGGTALLGNHDQMLLDFLTFPLIREADYEDLSEMYAMWMYNGGDKTISSLLDLDEHLQDAFTTRKMLLEKTNVVEVISLLEPYYEHGDTLCVHAGIPVYRQPDWKTATKDEMIWTRPLALQKNKTDKTIVMGHTPTINLRKENSYDVFLGDRSIFIDGACAYGGQLNAVVVDSKGSLLNTYKQESLSK

SEQ ID NO: 137 - protein, 159 aa, Unknown
  Description of Unknown: Undetermined Phage F170/08 polypeptide
MTMHTENLLAVTIFLLIQMAVVAFIFTKGIIVYDRLLSEYRDVVGIAFSILLFGNGAMLIIHQVIAIFSIWFNNSFRESDVFLAQGYFIVLLLLYIALNVYGSTLFKNIRVNIKNYINYNARSKNYKLALVIVITFIVNTVLVLATYWLAEVVKGAIIH

SEQ ID NO: 138 - protein, 83 aa, Unknown
  Description of Unknown: Undetermined Phage F170/08 polypeptide
MKPDYSSIIGKRFIPKKRYPRILMKEVYPTRVFYDFPRVLPWEKAPDIPLRVKFVEFTFIHEGRVEKERYTYYSFFTHFERSG

SEQ ID NO: 139 - protein, 203 aa, Unknown
  Description of Unknown: Undetermined Phage F170/08 polypeptide
MGREYVISDMHFFHRNICGEASFMDTRKQFKDVEEMNEYLINEWNTTVRPEDVVYHLGDFAMGAKVNSIANVLERLNGTIWLIKGNHDNSPLRKEIKRNTSLNDRVHWEDVGIILKRMHKVVHMTHYPLILGDRGNLINLHGHIHELARPEPNLLNVGVDSPELDNHKLGKPLLLEDAIRLVNKKQVNFNKASRAYSIHGDLQ

SEQ ID NO: 140 - protein, 116 aa, Unknown
  Description of Unknown: Undetermined Phage F170/08 polypeptide
LNYLYYVIILTMAHAVGDYALQSDYIAKGKQTDLYLLIIHVNIWTYIIVATTLFLGTPVKLGLIVVCLWVPHFIMDYLKAQSAWFLKTVPNKKTQLIIDQTVHYLQLAVFVWFATH

SEQ ID NO: 141 - protein, 38 aa, Unknown
  Description of Unknown: Undetermined Phage F170/08 polypeptide
MKLVTCPECGGNILEGAPNEYGFECDTCPYPYKEEDLI

SEQ ID NO: 142 - protein, 137 aa, Unknown
  Description of Unknown: Undetermined Phage F170/08 polypeptide
MTYRMKCVITNPQEPFFTEGKEYRIAHNNTIGYFIKDDDGTTAESGKTRGELLNKLNEYWYSQFELIEIEPKQPINECTEIRKKFQQTLIQYNMDIGHLEGRLVGKPSNIISTQIAMLKVKREAVQELYDELFKEDS

SEQ ID NO: 143 - protein, 128 aa, Unknown
  Description of Unknown: Undetermined Phage F170/08 polypeptide
MTVKIRCTLKTEHIFTEGKEYDVFYDDARGYFLRDDEGDIIESGATPELLLAELNNYWHSKFELLGAEPKKLTLYLGIDKGTGTNMAVGTSLQGVLEKVKELDIYFSSDSDFYANYKSQYIIEEWETY

SEQ ID NO: 144 - protein, 91 aa, Unknown
  Description of Unknown: Undetermined Phage F170/08 polypeptide
MTKLSSAWLVKFEYRAVKMRAFTSYDKAVTYYNEMVQNIDEQIEESYYETKTTYTDDHKPLLTQFIYWNEDRTFRNILGFVSIKEIELEEN

SEQ ID NO: 145 - protein, 75 aa, Unknown
  Description of Unknown: Undetermined Phage F170/08 polypeptide
MIRKQLLFELEVEVDEPMVGRNGYRTVMQTTRLYAYSLDDAYHAFRENHRYIIKSIKEVEEEINDEIKLSMVSEI

SEQ ID NO: 146 - protein, 57 aa, Unknown
  Description of Unknown: Undetermined Phage F170/08 polypeptide
MRIRKHANKIIGWLFIFLAVLTIVKVIVLGKPLDGFDIVLYVLLQLLYGMEKLSNDE

SEQ ID NO: 147 - protein, 114 aa, Unknown
  Description of Unknown: Undetermined Phage F170/08 polypeptide
MNELDGISKLEADIIKTTQLLETQQELKKNFIRNEKLSKRNYELSIDVLKLRNTLLDVMEDLDNLMENVEGIKEDANKHSKVEKEMVKGWLERTGKLANETRKNIEEVLESYEN

SEQ ID NO: 148 - protein, 84 aa, Unknown
  Description of Unknown: Undetermined Phage F170/08 polypeptide
MVLTMNKPVRATSEQVVYREEYANGWAVEVIHSLKGFGHIYVENKPYSVAIMKPAENFADYSTVGTAEEVLKLIEEVVEYEEDM

SEQ ID NO: 149 - protein, 84 aa, Unknown
  Description of Unknown: Undetermined Phage F170/08 polypeptide
MTIIDYGSKPLNNCSKNELLDIIQSQLENEVKLIKLIERTTKEVEEEKEVPHYKNYISPEKRSYLEGMERVENIVRNFYGFNNE

SEQ ID NO: 150 - protein, 111 aa, Unknown
  Description of Unknown: Undetermined Phage F170/08 polypeptide
MNYRIVSYENSQEWLDAFNEFSGNSFKMNEAIHPDIYEPIKTAVLLFNHEVAEGEAIRLEKIDESEEDTCDHTYETYAVQTGYSSIDIEQAGFCTKCGHDTHKGYKEYTLK

SEQ ID NO: 151 - protein, 145 aa, Unknown
  Description of Unknown: Undetermined Phage F170/08 polypeptide
MNNEVEVPKQVKEFIDKQREQLMDKLQIILEGQRYSCEYPKSEFSKWFFANTDTFIQAVANTASLPKYYVVMPEKQKRDYGLLLRKDGKLAVSILPRNEPLSQDTLSKLKDYYLTEAEIKEIDERYWLFKKTREELSYELQNCII

SEQ ID NO: 152 - protein, 153 aa, Unknown
  Description of Unknown: Undetermined Phage F170/08 polypeptide
MGKQILKGWVTIDNSPGAETNEPYLIKEKVKEIEYHHEHRALNMLICNALHALGAEDTTTEEEYDGGISSKYHLDNAEIQIFSAVERTSLEDITKNIVLKSMGVLDFEEGWYGWSSFTIEGFETNTFKLGGHDILNIVRQLEGKYVYITIDKV

SEQ ID NO: 153 - protein, 75 aa, Unknown
  Description of Unknown: Undetermined Phage F170/08 polypeptide
MELMIEGVSRGEFSKQFIKVSQTTEATVDIAVINRTVEVFRPDCVHEQTVTLTKENLDLLVTAIGYTKERMSNHG

SEQ ID NO: 154 - protein, 143 aa, Unknown
  Description of Unknown: Undetermined Phage F170/08 polypeptide
MFYKIIELMAELTKEIKEIKDTLGCSMPIAEDRKVTRIAYLSEQLDDLNSLLLDIPVNYHETWLLDEPLTQNTPYEFHIEVMVLPYGEMGVDVKCYYEEVASSISLGVDEFRTLPDTVDELQERTFHNFHGLSREEAINKWSL

SEQ ID NO: 155 - protein, 76 aa, Unknown
  Description of Unknown: Undetermined Phage F170/08 polypeptide
MSKELISCGACNEVFSEMDEVVRLTDDSMYHKDCVTLYSTGYCAFLDDEYLGDTENGEGEPACFFLEEGEYIEEEE

SEQ ID NO: 156 - protein, 143 aa, Unknown
  Description of Unknown: Undetermined Phage F170/08 polypeptide
MGLTKIETREWYNSDLDKLHKEGRDIYVKLKIGKRLTYGEYEREPNNGFQVINNEDTLPLILDNYEVYTETTTELTEKQLIVLVWLIHYLERTKLTIADSLHNLISGKANDATLQVWADLSSVEEAEVIRELVDYVIDKGGSL

SEQ ID NO: 157 - protein, 50 aa, Unknown
  Description of Unknown: Undetermined Phage F170/08 polypeptide
MANKVSLENLLAMAVTAKEHEMSRHANKMRQLEKTEANIKKRIKELSKEG

SEQ ID NO: 158 - protein, 255 aa, Unknown
  Description of Unknown: Undetermined Phage F170/08 polypeptide
MDFDKIYKDLVMDIIKNGVTELPEGTRAVYADGTPATTKFIEGVNFTITPDMGAPLLRSKHVGIKWALTELQWIWQEMSNEVSWLKERGVTIWDEWEQEDGTIGKAYGYALFNKERFIPVYSGDVELAKNRKAGSLIPKVVPKKGGWIAGTHQPYLKLNQVEAVIEQLKSTPNSRRIMTTLWNVEDLYDMSLEPCVWTTHWTVVEGKLNLHVKARSSDVCLGLPFNIIQYHALQLVMANTVGLELGNLYWTSDNA

SEQ ID NO: 159 - protein, 255 aa, Unknown
  Description of Unknown: Undetermined Phage F170/08 polypeptide
MNLQEKYEGINWNKIDDVIDQATWKKLTEQFWLDTRVPVGNDVNDWAKLSDMEQDLINKVFGGLTLLDTVQSESGVHSLLDDVRTQHEEAVLNNIAFMEAVHAKSYSTIFSTFNTPTEIDNIFEWVATNKRLQYKANIINDIYRNGTPLQKKSASVLLESFLFYSGFYTPLRYLGEAKMVNTAEIIKLIIRDESVHGTYIGYKYQLGFNQLPETEQKEMEQWVIDLAFKLWENETQYTAELYSEIGWTKDVNTFL

SEQ ID NO: 160 - protein, 255 aa, Unknown
  Description of Unknown: Undetermined Phage F170/08 polypeptide
MNTYIELNNQLNIPNNGKIQLDKDKEAVRAFFLEHVNKNTVFFYSLEEKISYLIREGYIDKTVITDKYSMEFIKKLFKFIYSKKFRFDTFMGAYRFYKQYAMKTDDGERYLERYEDRVAFNALTMGDGDEELAMKIADELINRRYQPATPTFLNAGRLRRGEYVSCFLIQVEDSMSSIGRTLNSALQLSKLGGGVGINLSNLRALGDPIKGIEGAGSGVVPVMKMLEDGFRYANQLGQRQGAGAVYLNVFHADIM

SEQ ID NO: 161 - protein, 80 aa, Unknown
  Description of Unknown: Undetermined Phage F170/08 polypeptide
MTKVTVYSKDMCGQCLFLKNMLNGKNIPFDEKNISHDEQALAYLKEKGVSSLPYVEADDGFSFNGVRPDLVKKLEKELGV

SEQ ID NO: 162 - protein, 88 aa, Unknown
  Description of Unknown: Undetermined Phage F170/08 polypeptide
LATRNKIGTYTNDEGNVVVQMAGSKAELLELLSFLNAKYLLEVTDTPEEYQKVFNRLQVETGKNYSVLLLDKVTNKSQESEDFLGDKV

SEQ ID NO: 163 - protein, 101 aa, Unknown
  Description of Unknown: Undetermined Phage F170/08 polypeptide
MKTTDLQKKELLEKDLRSYKKLYELQKSIKEEIDELKSSIISDMEELGESKISIDGGTFKLMPEYKRASADTKLLMNVYPNVWEKVKNVYTVNKYIKFTKD

SEQ ID NO: 164 - protein, 76 aa, Unknown
  Description of Unknown: Undetermined Phage F170/08 polypeptide
MEEKVPKPKVLKRVREARGESLRELANMIGVHWSSISYWENGIKEPRVKNRVKLAKLYNIPVEILFEEDNGQELPL

SEQ ID NO: 165 - protein, 74 aa, Unknown
  Description of Unknown: Undetermined Phage F170/08 polypeptide
MKKFYGIISTTTTRTEEYEKKLKNGKTEIRTREVTVPKEITVQSSQPDRLGARKELEAFARKCNGKVTYIGAFA

SEQ ID NO: 166 - protein, 94 aa, Unknown
  Description of Unknown: Undetermined Phage F170/08 polypeptide
MILQILGERKYDCKDSTEEPIVKPFIELIDGVQFLLEQENAFSLLNSKHEEITRVPNSPYEYRTEKEGYKTFVNSVYVLNDEGKTLRRLFERGL

SEQ ID NO: 167 - RNA, 71 nt, Unknown
  Description of Unknown: Undetermined Phage F170/08
gcugauuuaguauaauggcuauuacuccgguuuguaacccgggaaugggaguucgacucucucaaucagca

SEQ ID NO: 168 - protein, 255 aa, Unknown
  Description of Unknown: Undetermined Phage F170/08 polypeptide
MKVINYGSNYEIYANDLKTYDKLPAQTYKVRFNPMSGFSLAVTDDFKLKESKVYGDRLVKIEKVLHTFKTINRSLGVILSGDKGIGKSLFTQILSQRAIEEGMPVILITEAYPGIAEFIDSIDQESLILFDEFEKVFNDRDGRESQEKLLSLFDGLSQRKRIYALTVNNLNRVNDFMLNRPGRFHYHLRFDYPDADEIRTYLQDKLDKAYYGEIDSVVKFSRRIKLNYDCLRAIALELSFGISFGEAIADLNILN

SEQ ID NO: 169 - RNA, 74 nt, Unknown
  Description of Unknown: Undetermined Phage F170/08
ggacguuuagcucaguuggucagagcauucggcucauaaccgaacggucgcagguucgagaccugcaaugucca

SEQ ID NO: 170 - RNA, 74 nt, Unknown
  Description of Unknown: Undetermined Phage F170/08
cggaaaguagcucagcuugguagagugcaggcuuugggagucugaugucgcagguucaaguccugucuuuccga

SEQ ID NO: 171 - RNA, 74 nt, Unknown
  Description of Unknown: Undetermined Phage F170/08
guagguguagcucaaucggauagagcauccgccuucuaagcggacgguuggggguucgauucccuccaucuacg

SEQ ID NO: 172 - RNA, 72 nt, Unknown
  Description of Unknown: Undetermined Phage F170/08
agucgguuaguguaacugguaacacguuggucuccaaaaccaauaauagggguucaaauccucuaccgauug

SEQ ID NO: 173 - RNA, 73 nt, Unknown
  Description of Unknown: Undetermined Phage F170/08
ggcaguauagggcagagguugucccaacacguugucagcguggaacacacggguucgagucccguuacugucg

SEQ ID NO: 174 - protein, 112 aa, Unknown
  Description of Unknown: Undetermined Phage F170/08 polypeptide
MNYPKREKVVEVSLTSGTYSVFPRRLGVTTNDAMSIVNGAMKGAELPMIPVHKLADRDSELTYVNAFQIQTATENVVDVPERITSLYTKPEDETPEDEEIRLGTINNYFSLR

SEQ ID NO: 175 - protein, 114 aa, Unknown
  Description of Unknown: Undetermined Phage F170/08 polypeptide
MNDYQVNDLVLRLQRLEDKLQHGELTEKGIKQDNVELNSAVSELRDIVNSLDKRLAVHEEKYAHLTYQITKLEETIDALEGVNDKEFDHKRDIVENVFMIVLGAVVTYVFSMFK

SEQ ID NO: 176 - protein, 86 aa, Unknown
  Description of Unknown: Undetermined Phage F170/08 polypeptide
MYETALVCVLLLQMFVYLMSYYVTRALQYKKLQAELSPLASYKFTFVLYGISIGSLYLFFNGYYIPIVYTVGAIIGILVCLWFTSD

SEQ ID NO: 177 - protein, 89 aa, Unknown
  Description of Unknown: Undetermined Phage F170/08 polypeptide
MDNSKRIIKKIIFITISALVMVTLSKLFSKYVIVEQNAPFQALIGGASCALLSSILFDWYTNKKKKENVENQLKEAISDLQKIKAIIKR

SEQ ID NO: 178 - protein, 92 aa, Unknown
  Description of Unknown: Undetermined Phage F170/08 polypeptide
VSITNKDIKDKRRYIFSQSSKTTTIKRGDKRISSATRICAVCGRPLSKLVLRTGVPTVVVDHISCKISDIVRLNVCEDIRSCYAYSSKKGES

SEQ ID NO: 179 - protein, 142 aa, Unknown
  Description of Unknown: Undetermined Phage F170/08 polypeptide
MGMADRLKDNAKQKKLERTPEQQLRDTFNQASIKLINQFMANVTSGAIEVDDIADLTRLFQIYLQVNNINDGMQEGTGTLPALTSEHKDIISEKVSTEKIIKDGEEEELISLDELASLPDDQLEEVLVNRELQMNRENEATF

SEQ ID NO: 180 - protein, 255 aa, Unknown
  Description of Unknown: Undetermined Phage F170/08 polypeptide
MTTKAQHIAKMAKEMYGTDKITTEQLAYITDMLTPSTYLLRNHSVRNHPITFIISGRDATKAQAHRPWQPKIINDQHRDKAIIKSRQLGLSEMGVGSMLQFADTHSYDAVKCLYTFPTNEQMTKFVQTRLDPVLQNGYYSTIVDQEVNSLKAKKIRNSFLYFRSSSKPGAVEGVDIDYLSMDEYDRVPALAEASALESMSSSPYKIVNRWSTPSAPDMGIHGLFKGSDQHWYLHKCEKCNYYNEMSYDAYTPEAP

SEQ ID NO: 181 - protein, 255 aa, Unknown
  Description of Unknown: Undetermined Phage F170/08 polypeptide
MVDNNVKISKSTIEGLINKSLSYEYVIKNNELLTNEYQHIVKAYGFDNFYDMYLYADSCDSKDMYLVKGGQKDLSKLKPVKRKVVRNGKTMTTTIYEDTGSSDNNNSNPLDKESKKKKELEPVNAKELRKVSLGSDEEEKLDPKKIAKLLADTKKFGNNFDTQCTDYLILEQDSVTRGVVGFTREGSYLKMSFSMSDEAVEGMKMLAFSQLTLKAWKLGLGAKISTDNAPDVEELISLYGYKRNKTEYIVSMSSL

SEQ ID NO: 182 - protein, 210 aa, Unknown
  Description of Unknown: Undetermined Phage F170/08 polypeptide
MELIMNNKKLDELTNKVATDEDYDIFVEKMGNLVKDLYENYQFLQQNPPEGDYTSGYFLGFQVIRAEYPVEYENLFRLAVDKNLNELEINKRFVEAVKDGKVLPLGEAVIDELQTGCSSILQAQEVRVNIVFGTKEYMAKQEEERKERQAKLEEERERAMEVLKTKDDVLNTLRVTEALANELTDEVAEKYDLMELVNSMREGLKAHNGN

SEQ ID NO: 183 - protein, 114 aa, Unknown
  Description of Unknown: Undetermined Phage F170/08 polypeptide
MEIKNSLGKALIKNLRLLKEKRDAMPDNLEYTSQVMIPVPYYLIKKGDNAVESFLMCAGMINRNKDLGLPISLEKGKQQVKLNNGELTTIVECVATYSDKTDIDGVERFLVEHL

SEQ ID NO: 184 - protein, 255 aa, Unknown
  Description of Unknown: Undetermined Phage F170/08 polypeptide
MAGEVFSSLITSVNPNPMNAGSRNGITIDTIILHHNATTNKDVAMNTWLLGGGAGTSAHYECTPTEIIGCVGEQYSAFHAGGTGGIDVPKIANPNQRSIGIENVNSSGAPNWSVDPRTITNCARLVADICTRYGIPCDRQHVLGHNEVTATACPGGMDVDEVVRQAQQFMAGGSNNAVKPEPSKPTPSKPSNNKNKEGVATMYCLYERPINSKTGVLEWNGDAWTVMFCNGVNCRRVSHPDEMKVIEDIYRKNNG

SEQ ID NO: 185 - protein, 212 aa, Unknown
  Description of Unknown: Undetermined Phage F170/08 polypeptide
LKKTSILGLSLLSLGLVVGLGTEAKAEEVTENGKTYWKVESGDTLSEIGAKYNLDFTNIHKVNKGVVADPNVIFVGDKFLLPLDENGKLVEQVNTTEPDIEVQYNAPVTPEQPVVVEQEVVEQPVVVAETPAPVVEAPADSSSAKEWIAQRESSGSYDATNGQYIGRYQLSASYLNGDYSPANQERVADEYVAGRYGSWENAKSFWLANGWY

SEQ ID NO: 186 - protein, 114 aa, Unknown
  Description of Unknown: Undetermined Phage F170/08 polypeptide
MGYIQDETWQMVKKVAKKNGFVGDWILIIHSYYEYGGNHVQIHTTINGESYRILRLLDSREILLLDRKGNPVIYDYEIVNDGQKSFFYNDMEEKEIEIPNGRCLNDKTRVKIYV

SEQ ID NO: 187 - protein, 255 aa, Unknown
  Description of Unknown: Undetermined Phage F170/08 polypeptide
LPKWLDKALGIEKSSIEETRNMENYKMHLREIDTNVVNNEPYSMESIEKGMNGKTTAYMQPIIGEMSVNPGYKTKPSIRNSQDLHKTLKKFGNNIILNAIINTRSNQVSMYCKPARNSETGVGYEIRLKDIEAEPTSHDIANIKRIESFLENTAQFRDPNRDNFTTFCKKLVRATYMYDQVNFEKVFDKDGNFIKFDTVDPTTIFLATNGEGKLIKNGERFVQVIDNRIVAKFNERELAFAVRNPRADIEVGQYG

SEQ ID NO: 188 - protein, 255 aa, Unknown
  Description of Unknown: Undetermined Phage F170/08 polypeptide
LSEVREKYSIFVPLDIENSIQKSESVNDGEWYVQGYATTPDLDLQGDIILPQGIDISYFIENGWINYEHKNDAEFIIGAPTSNCYVDVDKGLFVEAKLLKDNKYAQSMWKLANTIQKSGISRQLGFSIEGAVVSRNAQDNRIIEGVKIHNVALTTHPANPRATWETLVKSWTTGYGTAPDAQVDAGALRREMFKEDISNLTYAVRTIAGLYSKKPAEKEFILREVAKDIEVDTSENELSKFMLQLSRGISLKEAT

SEQ ID NO: 189 - protein, 255 aa, Unknown
  Description of Unknown: Undetermined Phage F170/08 polypeptide
VAKTLNDIIEDFDAQLNEKVKPTTDEEITKSVEEPTEPEKVEEGAEVEQEEKPNESEETAGNDGEESGVTETVEAEQEEPETVEEVVVEEPVEESAETVEKSDKTKENKDEEEEEDEEDEDKKKEKDKKDKDKKDKEDKEDIEKSTEVEQVIKSSEILGAMEAIFKNMLGLSEKLDEIHREFKEAKEAKEAKEKDEAESVEKSLLDNPEIKTGKEDSEGKAVGFVNKSVAVEEEVATEEPTVDVVVDGEQDTAEP

SEQ ID NO: 190 - protein, 255 aa, Unknown
  Description of Unknown: Undetermined Phage F170/08 polypeptide
MTEKKNTERQLTSVQEEVIKGFTTGYGITPESQTDAAALRREFLDDQITMLTWADGDLSFYRDITKRPATSTVAKYDVYLAHGRVGHTRFTREIGVAPISDPNLRQKTVNMKYVSDTKNMSIATGLVNNIEDPMRILTDDAISVVAKTIEWASFYGDSDLSENPDAGSGLEFDGLAKLIDKHNVLDAKGASLTEALLNQASVLVGKGYGTPTDAYMPIGVQADFVNQQLDRQVQVISDNGQNATMGFNVKGFNSA

SEQ ID NO: 191 - protein, 87 aa, Unknown
  Description of Unknown: Undetermined Phage F170/08 polypeptide
MLKSEILINKTVTTAFGEVTFDHNGETTDLTVEQQEHLGTKVPYIQYIPDAPKAKEKEATAEKADEAPKKAKKAPAKKTTKSKKEED

SEQ ID NO: 192 - protein, 255 aa, Unknown
  Description of Unknown: Undetermined Phage F170/08 polypeptide
MYPDYGYEEQGDNTYQYQPYAHGNPKHIDLDKIDDIQPADYGWTPATLKQYMFGVEVVNPETGEPLGDTFYEHIIDSAIAKAEKRLDIAIMPRLIRGEHHDYHQSDFNSYMYTHVFKRPIIQAEKLQLEVNGRGLYRYPSNWWKVYALAGHIQMYPTSLMQTGTQFGYEMTFSGYPQLAGMPPSGGQVDAPQMIHIDYVAGMLPRKNRGYNEDWECPADLEQLVIKYALKEIFQQWGRLIIGAGIASKSLTVDGI

SEQ ID NO: 193 - protein, 255 aa, Unknown
  Description of Unknown: Undetermined Phage F170/08 polypeptide
MGEKPIRFGGAGETGNPNKQLNTSRVEFETKGMASFIENRGIDVLWERAWLCTCRNPMTLSPKSDCPICRGRGIAYQPAVKLRMAIQSQEKGISNQDLGLLDTGTAIGTTELDSKITFRDRITVPEVKIYQSFIFNVNKRRVANGLFLSYDVNSIEDIYGKDGRILVDGVDFRMDYDTNTIYPNESLIDTNISINMSVTLRYIVIDLLKESRYQYTTFGVKQTQFESLPKKLLLKREDVFIDSEPFSLDIDTASR

SEQ ID NO: 194 - protein, 207 aa, Unknown
  Description of Unknown: Undetermined Phage F170/08 polypeptide
MARKGQRPVLFTDSKAILGNLTRAVVDEVLSDAQDVALRNGSSVQRMPSYLIVTESRMAKNGVIDLKPFFARSNKKKYNKKGEWYLYIPISMKTRNMSRRLYDELRAVPVGTKPVTVKMDYLYDRRKQSPSVSSINYKPKSTNVTVIPQSWGKGTRNTYVAFRTVNANSPANSWIINRRNVNDDDMSKTMLRNIDRLMKWKLKNLGG

SEQ ID NO: 195 - protein, 255 aa, Unknown
  Description of Unknown: Undetermined Phage F170/08 polypeptide
MIPSLDTYLYKEFEERLRIILSECYIIDEALKGMDKEALESFKNTYCSIDGKPPKREVEMSYSFPQEHLDSFARFVVTLGSSEEDSKSIGGIQGGYEYREGNVISEEATIIREGDKLIINTSKPVADYLNSSDISFAESDHFRIEDNKPVFDFSYNEELEGISINVSYISKVSDDDVAGVYKGYQSNDNVSIIGISSNIDTARCLDAIARIILITMRDSLDEKTGYMLQTLHFGDMQVVIESGETLVFGRPCTVN

SEQ ID NO: 196 - protein, 77 aa, Unknown
  Description of Unknown: Undetermined Phage F170/08 polypeptide
VAKETEKVVKKEVKKEQPKKPKGYVHVDTFLDYAKVLYGLNKYQVAGFRALMAGREYQHEDADFVPFLEKYIGKEVK

SEQ ID NO: 197 - protein, 255 aa, Unknown
  Description of Unknown: Undetermined Phage F170/08 polypeptide
MAVEQFPRKKVSRPHTEITVDTSGIGGASSSSDKTLMLVGSAKGGKPDTVYRFRNYQQAKQVLRSGDLLDAIELAWNASDVNTASAGDILAVRVEDAKNATLTKGGLTFASTIYGVDANEIQVALEDNNLTHTKRLTVAFSKDGYKKVFDNLGKIFSIQYKGSEAQANFTIAQDKISKKATTLTLNVGAEPESTTEVMKYELGQGVYSETNVLVSAINSLPDWEAKFFPIGDKNLPTDALEAVTKVDVKTEAVFV

SEQ ID NO: 198 - protein, 140 aa, Unknown
  Description of Unknown: Undetermined Phage F170/08 polypeptide
MASVGNQTVHTGNTVYLMIGNKIIGRAQSASGERQYGTQGIYEIGSIMPQEHVYLKYEGTITLERMRMKKEDLASLGITALGEDILQRDIIDIVMMDNLTKEIVVAYRGCSAISYSESFTANEVTSESTQFTYLTSAKVK

SEQ ID NO: 199 - protein, 48 aa, Unknown
  Description of Unknown: Undetermined Phage F170/08 polypeptide
VKYPYLVELYAKHVIRDSGYIENVPPVIYEDVVKRVEEIKREENLTID

SEQ ID NO: 200 - protein, 157 aa, Unknown
  Description of Unknown: Undetermined Phage F170/08 polypeptide
MTENNEKVFTPTPNLSREQLIEKLQRGENLTDEEVNILKYYNDAEERKQLDRIIPGVNDVFSKHYNLKEYGLEFDIKIKAPNIIENGKIQARREAYLEGMGMAVSNFIFQSYQMLATIRVCGVEVPEVLADDEKIYNLYVLGVIAKDYGEWLNSFRY

SEQ ID NO: 201 - protein, 191 aa, Unknown
  Description of Unknown: Undetermined Phage F170/08 polypeptide
MKKFKVLPSDPAWQNLTSDQVEWILYNMERDIEEQERLAKGMQLESEFQDYDDSWYDKPHDEFSPIREGDDEEEIARKLSEITSEEDMAKLKARWEASQEVDAIRAEGGTTIEEDTINELIANNVKKAMEEARRIEKHGGNKWQEKSSIELEEERKNLEFNSQLKQGDIQEAIDLFNKDVEPTSLDDEFQI

SEQ ID NO: 202 - protein, 255 aa, Unknown
  Description of Unknown: Undetermined Phage F170/08 polypeptide
MSNNYRFYVEAMTGDAVAKLNEIDKLMDKIDSKSAKGTQNFFHTSQKDIDKAVEEMQKLIKAKKELDRAFDNQKINAESMGDMTAYKRAVSDAEELTRRFNKTQKEFQNHARMQANPNYINASTLRQQKAFRDELTEQERAIRNISRAQQELNRVNSRVNHRANQASATGRMTYNQSESMKRDLRRTGVFESLGSENKSRQQELRERYKQRQEELAETRSNTNLDRQVRKNRETSIQAEIKEIEKEIEARKRLAD

SEQ ID NO: 203 - protein, 255 aa, Unknown
  Description of Unknown: Undetermined Phage F170/08 polypeptide
MSVELRYPRFDLTFFTETDNYHIVYDAKDGLTGRNNNNGETEKVSNNFMAESVISLTTKNALEDDSAVFSFVLAGDVYWDRVLNANDAVILKIDPDTSSTKKSDNPVLLVGLISEVRLEGDYGENSKMYRITGQSFAKALMQFDLGVIQEVSVVLTDLGWLPDDAQEGIKMSGSSASQIAESLMKRFLQYMKFNFNGQGIDKFLEWELDSWTEAERLIDSTPYINYEGSLKQLIDDVTAKPFNELYFDATPEGKC

SEQ ID NO: 204 - protein, 255 aa, Unknown
  Description of Unknown: Undetermined Phage F170/08 polypeptide
LVKRRFQAGLGSEIKRVYKEGQQINTLLLAQVIQVNYKYNTVDLLALQHKEVFQNSYANEGRFSARLPMEFGGRNIVGQPYGQVNPIAVGTVVLVGFINSDKDMPIVISVYNNNDVSKQLSRTQFSNSDPKDLELIGDMHQKFSLYPSLTYDSVDGEGGRVVTFSGKSFIAFDTKEVANSSTTDAGYGTKYEDLETSYYNNGDLIEPMKGRAPNVLFKHQGVLDDDGKPDLHDLLIHINPDGTYRTSMMNKEEDW

SEQ ID NO: 205 - protein, 255 aa, Unknown
  Description of Unknown: Undetermined Phage F170/08 polypeptide
MALNGTKYTAFARHRLVLEWRANQNIAGNYSTISVWLYLQSMDKWGRLDAPAIGDAKVTVDGTTQTEKASSMLNAFQKKLLLAKEWRVNHNNDGSKRITIGGSYFVNVTFTDNGVPTYYGTITIPNFSVDLNRIPRRSSLNPVPTLNLPGNLPITINRQSSTFKHNLTAWVANRDNPTLNNDDHWTYLTNLNDVGTSGAFSFTVANNKTIFTALNNRTSWQGKVKLWTIGLDDVVSQERTYKIVPPMNAQASGGK

SEQ ID NO: 206 - protein, 241 aa, Unknown
  Description of Unknown: Undetermined Phage F170/08 polypeptide
MVEETQKIFVTLDDKDFVSNWGTSLNSDEPVYEVDLPMDSPFFSHYYSNCFQYVDGELVLSEEKLLKVELLAVASKFKRDCEETYILQKVPYTISGTTYLFDVISDDEFINKITLLDNKIQDYVGITAYATSDGSQLILKFDKSQYTTMTRYIKKVVESRENKLNNKLLPMIENAKSVEEAKEISWSSVPDELLPEQESNEPQDEQSIDSLIKENKELRQKVEFNELALMDAINMFSEMNK

SEQ ID NO: 207 - protein, 48 aa, Unknown
  Description of Unknown: Undetermined Phage F170/08 polypeptide
MYPYLSMLYASYVIKDPENYPLEKVPALIREDVEKIVEEMAKKNEKQG

SEQ ID NO: 208 - protein, 229 aa, Unknown
  Description of Unknown: Undetermined Phage F170/08 polypeptide
MGQSDGMGGTLKRIAIQVGNDPNKGWYRFQVNPTQYKYNKPHRVTIFKTKSNIITEDFGKDIETIQFSGTTGFRVDSRGKNGADRLKELEEIIDNYAKQGGNGNRSSVEMKFYNFTDDKYFVVHLAPEGLSIERSAEQPLLFNYTLSLVVLREAGQPSERAQVSPQIGNVSPSIGRTYNAQQDTRTPAQILHDEYRRSVMPNTAVNPAVTSGAYNYGVNELKKIIGYGG

SEQ ID NO: 209 - protein, 178 aa, Unknown
  Description of Unknown: Undetermined Phage F170/08 polypeptide
MEKVEQSADLLRFFRYLNVDINGEVVANVIDDQPNFISRFYTPHTRVNKISSTLLDIVRDNDIGETNKALSKDSLTYKFLKSGLKLSSPRIYELAQIVVLESFALIYAIEEEPEMFKMINESDVKQTRENVKYLIDCLGGAKDYTDIVMDLQSMDVALGYIQEQVPLIQGGLPVNGTI

SEQ ID NO: 210 - protein, 234 aa, Unknown
  Description of Unknown: Undetermined Phage F170/08 polypeptide
MARYKKHLIVYGDTMQSIAQKETGSVDNWVKIAEYNDLVYPYIVDTMQEKMSNLEHLATLGDTLFIPDEGNLLDINTSSLNQRDMDFLLGLALGKDLDMTSDTDYYENHGTSDEVFAITHNGHGDLKIASGADNIKQATISRLMTAKGSLMLHPEYGSDLHLMFGKTTIEQMKIISIEVCDTVLKDTRVAECVLVNHYIEEDRYVGNYRATLQSTREQFEFVVQNDNSGALIIV

SEQ ID NO: 211 - protein, 255 aa, Unknown
  Description of Unknown: Undetermined Phage F170/08 polypeptide
MRLKKISEILGRLIDVTMINTHEINDFSVGSTIRSIYEAVSMELEQYYILGRENILWGIEQGVLNAFDFRKREAKRAYGMVTLEFHTVTQTPVYVPTGTTFDSSLSGAPSTLTFQTMQDYIIPEGVITAKVEVYCTTVGTKGNIPKGRINRVINNISNLKTVYNEFDFLTGTDEESIESVKKRFHAFVESRGRATIKALDYGTRQVEEVAGVYIKEEVGYVRIYAHDLNGDLKQETLDKIKVAIEDYRPAGIKLD

SEQ ID NO: 212 - protein, 255 aa, Unknown
  Description of Unknown: Undetermined Phage F170/08 polypeptide
VSNFYKNIHPLLRRGKKPNKYDDTNFAVLNALNYELTQAEQETIASKIHSSLETATGEYLDTWGDWFGVYRKDDWNDEYYRKRIIRELLLKRATIPAIIDALLDFLNDNDAVIQIYEPWRNIFYTNKSKLNGDDHLMGYYYRFAIIDISIDRPFPPEIVEIIKAFKPAGVLFYLRLDTSLNKNKTTVESPYVYLDVTNKTELEFLNGLYYDLRGNINLSDQRTQVVESNIFHTNNSMLNGEDVLAGAFDHGRGYI

SEQ ID NO: 213 - protein, 181 aa, Unknown
  Description of Unknown: Undetermined Phage F170/08 polypeptide
VAIATNNSRVYASLQLKNKQDSMYLAIGKTTPWTNEDAPPAPDPNTTTLTEVIGYKKVARVSLCREYLPSDDSKYPVVSYGSRKFTLIPDEDGYKEQAWMVYVEAEITGDELPTGTFRQVGIHTDLVSKASSEKKALLPTDVTDAGILQFFENRQQQNRTSDVILKEKFIITMENKKSVKQ

SEQ ID NO: 214 - protein, 255 aa, Unknown
  Description of Unknown: Undetermined Phage F170/08 polypeptide
MAKNITNDDLGKEPYNNRYYQGKRFSGLLFKPDKPLQQAELNELQSIIQGDLGNVAESIFSDGDIQTGMEYVLQDKKLTIKKGKVFLGGKMRNFDEQSIDITGEGTEYVGVKLVQKVITAEDDPSLLDQTSGVPSHFSEGADRLDEDVVLAVNDDSASNIYHFVNGELYINPDTPEMDKINKILAERTYDESGSYRVRGFDMYTEVHPTDPNNKIQLVVDSGRAYVLGFKVDKPTTTRIDIEKSRELETINNEGF

SEQ ID NO: 215 - protein, 255 aa, Unknown
  Description of Unknown: Undetermined Phage F170/08 polypeptide
MGKFKDLTGQTFGKWTVVDIDETKDRIHWWCECECGKEQSIRASSLTSGNSKGCRECTRNNLMGKTFGRLAVIKDSGERAKNGNILWECVCDCGKKRLVLGANLLNGQTKSCGCYSTDILKKVSTKHGLSKVNGKKTKLFMTWDAMRQRCTNSNHASYKDYGGRGITVCPEWLNNFKSFYDWSMDNGFSNDLSIDRIDNDKGYSPDNCRWVDAKTQIRNRRNTVTYNWKGSEYTLAELGELTGINKMTIKSRLNR

SEQ ID NO: 216 - protein, 68 aa, Unknown
  Description of Unknown: Undetermined Phage F170/08 polypeptide
LPETHRQTSSGALIFKPTIAEQEHKNAMESIKQERTELEKELANVKAIKDELSKELADIKQLKDELSK

SEQ ID NO: 217 - protein, 255 aa, Unknown
  Description of Unknown: Undetermined Phage F170/08 polypeptide
MRLVVDIMHTQIRYEDSENYLRPEIHKVMHSELGVKADGYQFSPAYKAGYWDGIIDFFDKENDTFPTGLLPHVETILGNLQSTLSKSGYIFQFEIIDDRPDEFMSVEDMDKEIVLNGDNNDKITLRDYQYESVEQVIKNRIGIVNVSTGGGKTEIASGLIQQITPYLESGERIAFFTNSSSIFSQSIDRIEKRLGIKVGAFGAGKKDIQQVTFVMIPTIVSAISADPEAKLKLTAKERMYKKIAKDIAPKFERGF

SEQ ID NO: 218 - protein, 255 aa, Unknown
  Description of Unknown: Undetermined Phage F170/08 polypeptide
LQSPCLNIELKEKFKLNKGITDFLERVADKSQRWGETVASPIRKTDMAKETGKNPRTITRYINQLEELGLIKTETKRGMNGGTLVVFNTDMLNFEPKENPITSDTKQAKEIREQVFPKAPTKVPKRRYRTKAEIAEARILSEKLKKREDILNDKIEFNVVTRSFFDSFDEPEVYFKGYLISRMYNAYVTIIPYEKYNRLKNLDEKKAKQQLRAYESSYNYDVLPRRFVGTPQYKKFVELAKYCEENNINPLVYLT

SEQ ID NO: 219 - protein, 255 aa, Unknown
  Description of Unknown: Undetermined Phage F170/08 polypeptide
MSQIQKQVIYRALSEPFFAKEILSKIPMDEFKDSGYEMIVSTINLYYRTHDESLEEQSLLTLVEDKMLKQNKSLEAQNKVFEVVSDLYELENEDVDSEVISENIQNYVRKVLTREAIMKSVTNEGTLGSDSNIQQLMDDLRDILTIETAGNNSELLDFFDDVDKKMELLANLQQNKYPTGFTAIDAISDGGLARGEVGMVVAPTGGGKTTWAVNQARNYVVRGLNVLYVPLEEKVDRMIVRFEQLLSQQSKKNIL

SEQ ID NO: 220 - protein, 255 aa, Unknown
  Description of Unknown: Undetermined Phage F170/08 polypeptide
MKHIINFSDFHMHFFKDFSKPDPEYGTDRAKEQITILDNLMNYARNKNGDVLFNGDMFHKRVSIDVRIFNMLFQVISSYPDVDVIMVSGNHDKVTNSLYSDSALAPFSALPNVTVCSTLNKIVKDDYTLYAVSYGEEVEEMKAWIKEQADNLDHETVNILSAHIGVDGSSTGKYSHTLGGAFKVADLYPDKFDIVTLGHYHKRQFLGNLSNVFYVGNTLQTSFADEGQEKGFYDITIEGKKWEQKFIKTDYTPFE

SEQ ID NO: 221 - protein, 255 aa, Unknown
  Description of Unknown: Undetermined Phage F170/08 polypeptide
MLKFKRVSAENYMSIGSVSIDLDNQGLVLIEGINDTNETFQSNGSGKSTLLSTVTYALYGATPSGLKADAVINKQAKKNMSVILEFEKDGVPYRIERYRKHSKHKNTTRFFQGTNDITQKSVADTDKKIQDVFGIDYLTYANSIMYGQGNVEIFATATDKGKKQILENLADIGVYRYAQDVAKERAQKALALAEELNRQYIAKVYEKDGLTQSYNSALQQYENTEKLIQQKESELANAELVIKQSEKNLSEGRAL

SEQ ID NO: 222 - protein, 221 aa, Unknown
  Description of Unknown: Undetermined Phage F170/08 polypeptide
MKIYTLSRELNEGTIFVPTSSSNEGKLFSFPLGTLFDWYPCCPRYEYQYSTSRKKLYLRLLDSDKTLVARYGVGDNKKRVISKIACFNENEWYNEEVANENAELFNFAEQYDIVTPLKDDYTLKEVDDSISKVLDILDLLYTNQKVKVEEELINKVDTLQLSKPDSDELKQAYKDISEYMRLDREEKATYVLSRSLDSLNSVYEKFGNVYTMLNIMRKVVA

SEQ ID NO: 223 - protein, 255 aa, Unknown
  Description of Unknown: Undetermined Phage F170/08 polypeptide
MFTDLLSNELGSPKYAVRDYRYNCPFCDYDTKYKFYVRVEEGHPKNNLWHCFKCGSSGNPVSFVMKYYNVSFKEALEILEEYGYRFNNKNYVPKSDKLTDEEYLLLLLGSLGKPKEETKQAKKELVAPPLPDGFKLLSQNLREPEAYPFLLYCNKRGFTLNDIYIHNIGYVKDSWVPLENGKSVRLKDHLVFLTHGKDGKYQYWNTRAIGQSFIKSLNAPSKEGEHSKKDTIFNINRASQTPQIVITEGVPDALT

SEQ ID NO: 224 - protein, 210 aa, Unknown
  Description of Unknown: Undetermined Phage F170/08 polypeptide
MRYTLEDLHAGMKLRCTDSKNYSFWTTNKIYEVTKKESGSLCIFDDYGIESLDEDILVRLNGNTGNAEFEVVSKVMKDADYTEEDLEEGMLLHCKDGMSFPWWATGQTYEIYKGEKGILFTKSGDGNQYCAKEIVARLNGSASGSFELLERPHKTELEKKVEARIKELKEKKLCLFYKQQQIKIEENEISIEISKLSEALKAIDVLREFE

SEQ ID NO: 225 - protein, 255 aa, Unknown
  Description of Unknown: Undetermined Phage F170/08 polypeptide
MGRVSVYFLNSRNIMDEDETKRTYHGTFNSMKEAEQSVRDWWKANDFKCGTLRIIEGTEDGIVRWDYGNHTGFYLFVPEGAVVKYTIREGAKKPKRGRENDVAHDLFTADDGVVIPGRLGSNVISTGIKTSFDPKQYGLFINPRGGMMKYPITLGNTQGVVEGEYRGEVGLPLKNTFSLQLDARAVSKNVLTINEEGKLINIPVTVARSMYPSFNALYEKQLEKLSEELQLVYGGEVRISNADEYVVAGTLFIPK

SEQ ID NO: 226 - protein, 76 aa, Unknown
  Description of Unknown: Undetermined Phage F170/08 polypeptide
MLIPEFKPPLLYVMGSFSVMLEKHQCSVTFYLREPYLGTSYDKIVKLIKMTYPNYSLTYVGMADNKYKFTLKNKED

SEQ ID NO: 227 - protein, 102 aa, Unknown
  Description of Unknown: Undetermined Phage F170/08 polypeptide
MYTKKEEVVTVKHLVDKEQIRVGDIVGYKKTIRGFDAKRVKDTLSVTNQIGVVSRVCDEYITVHDFFDKCSREIWAKTFENLEVRKIEDGNSLLRRYENEFR

SEQ ID NO: 228 - protein, 103 aa, Unknown
  Description of Unknown: Undetermined Phage F170/08 polypeptide
MNFVDYFNQMQNLVIEEKTDEYVLLEKEHGQKYVTYQELEGALSTVARNTAFMVENYNLMQDINLKIVLKKLKDSGTITEELEKEILKEFKNIESLMEDETYE

SEQ ID NO: 229 - protein, 123 aa, Unknown
  Description of Unknown: Undetermined Phage F170/08 polypeptide
MSKESKRNKRIGELSEADMRVWAEWLATGQVHDKNHQKQLERLSKRSVSLSDVTTIVEFMGKRNDGYISSLIEQQAVFDNLLTKLGVTEENRLEAKAEYEKELSLIQEKIQKELESIKENKEK

SEQ ID NO: 230 - protein, 222 aa, Unknown
  Description of Unknown: Undetermined Phage F170/08 polypeptide
MTDYSAVGKKSRNKGGRFERQMAKELTEWWGYEFNRVPASGGLHWASSNNVAGDIVVPSDANFPFVIECKNREYWTIENLFLNNKEIKNWWAQVVGDAKETKNIPLLIFTRNRAKNFVTMAYNEKLVNEIEKRGYPLMVSNITYVDDYKDTHCYKTFTTVLDAITSFKPYGSKDKDYFLFYFPSDYNWEDSLVYETTIMDDAKQMDAEDSLDALVNSYLGGE

SEQ ID NO: 231 - protein, 99 aa, Unknown
  Description of Unknown: Undetermined Phage F170/08 polypeptide
MAKTYQEALATVQSYLESDSVMKETSSISVSFSANWTGEREDYVIDTLTYDIDLRVFSLETAHVVAIGKKLPQDSNEHAELLKRLKKEFKQASKKLRED

SEQ ID NO: 232 - protein, 159 aa, Unknown
  Description of Unknown: Undetermined Phage F170/08 polypeptide
MIDNVNSPSHYTQGEIEVIEVIEYITAKYPAEIRYHLGNVIKYICRAPFKGKLQEDLNKSSWYLKRAQLVLTWSPSSYTGKCKKFLENFLFKNSHIRDAQLIEIPEEPIIEKFLFQTAQSYNKEQQNYIISALMELNSSSGDVKTVLENTENYLKFITT

SEQ ID NO: 233 - protein, 255 aa, Unknown
  Description of Unknown: Undetermined Phage F170/08 polypeptide
MTKAPRVKRLNIYNTDRYFNINLMKKEDIAKKIKVNRLNEEEIEREMDELASNPLKTPIGYMDRTNEKSYILYQEKYTNDRLIQKLFKHAGSVSYYTDTIVPYYIIEQISKNLTSEVIYPTKNSYENREIENVQLAFTACPVTIDCPVVLPDVSPYDVLFALHPLKTNVDKIQISFPCLTEEEFDTRHEEYYHKVGSHYEVKSEYKYKFFKYVQTSLSIWAMNIWLVCDSDEDYNKIDRYIQKEKIKRNANRERA

SEQ ID NO: 234 - protein, 103 aa, Unknown
  Description of Unknown: Undetermined Phage F170/08 polypeptide
MSKDKTINRTDIARTISHHTGYRMKDILKILEVEDEVVAQAVSQGISVKNHKLWKLNIKKKPEKVAWDGINSKSFIQPEKYVVKFVPLSKLKESIDTYNKESK

SEQ ID NO: 235 - protein, 255 aa, Unknown
  Description of Unknown: Undetermined Phage F170/08 polypeptide
LKILFLQEYIRENHVHNGKNGQTVDFKRTEMGKKLTGLLNTIGLTGRDYAVDYVYDMIPEVQKVNPRTGKPIKYKTPTLRQRKEPEERLLRRLMKYKPDIIIPMGEMGCKNLLGSTSITKNRGVPTKKTITNENILRTADEQGLEVDEVVDSFETWVLPMFSMEYWTANPNIENFIMADIDTLGKFVQEGEQAFIPKKVDYEFVDNIERVRQIFGFLDKTKPVTAWDLETNSLRGDLLGAKPLVMSMSWLEGQGV

SEQ ID NO: 236 - protein, 180 aa, Unknown
  Description of Unknown: Undetermined Phage F170/08 polypeptide
VLNLRVDDLEFKTIKIIDDNGEVVTHDLQTELQVNEFNVRTAFLEQPAKYTYWTSILERLRMYQENYELKAEKKKAELYEPSRVALINQGVAKPTKDQIEAQIMLDEDYYKLRQSIVNLSFNVRQLQYIVKAFEQRKDMLIQYGADLRREYEYSQKVSMPDPMKNKVNNGFSDFQWNLEQ

SEQ ID NO: 237 - protein, 255 aa, Unknown
  Description of Unknown: Undetermined Phage F170/08 polypeptide
MNFQEQLQQQLKQQNIGEREAVDYPSNHLKHKELYFPKAENGQPSTLYVRVLPPAVPGENYNVSAREAFLTTRNRNGKDLKSNFIFSEHPNAEDILEQAMIRWNAENRVPNPYSRNTKPRQRYYVNVVQLIINQQTGEVNYETDSNGQLMVRLLKLPQTACMAINESLSNPMLRPQFSPDVPEEVAQYSFISSADAFPISITKPPRSNKPTSYNVQVISNRSLGALPQGWENLLEDLKYQATPSVEYNREFIEYF

SEQ ID NO: 238 - protein, 255 aa, Unknown
  Description of Unknown: Undetermined Phage F170/08 polypeptide
LARKRKSEEIDFGTIDLTKEVGLTTFTDTKFSNVSDRLPTMIPQLDYILGGGLPFGRMVEVFGKNSSGKSTLAVHLTKVAQMLDVPTVWIDVEGTADPERLAELGVDFSAGGVFMVEPKQNKDGSKDTITVERVAEELQRLLPVFSKLGKPVLIIWDSVAQTASEKELEKGVGNQQPGIKAKAMAQFAQIIAPLMTNSKALFIAINQARDELGSMFGGVDSPGGHALHHWASLRLEVVKASQIKNKELNAFGAEE

SEQ ID NO: 239 - protein, 128 aa, Unknown
  Description of Unknown: Undetermined Phage F170/08 polypeptide
LRKGLAPNPFFEILEKHQDSSKRTMTMNSSGTPSSLQPIRDMFLKAMREGKRVLIENSDLSSANSVVIEIEYVGNRWCLGYQRVLFYGMELKIPHTIHFCDVYGAYGHDAQKVKRQVKVVFEGDNPFE

SEQ ID NO: 240 - protein, 204 aa, Unknown
  Description of Unknown: Undetermined Phage F170/08 polypeptide
LSRDVQKEEKEIRNGNRFITETHGKGVFPRDVDRLYHKYSNLRYKVYNTHKDSFNSEASRKELKSYIDEQFIKLTKEYDINGEVDFPGYIKKALNLRVRHSYVKGRFRDTARERLGTQDNEVELLLGIDDSSQADIEDAELIESLLSKANFSEIELAVFQQLIQGTVRDARIITELSENYGVSKKAVKDAIKNVREFVLINLTD

SEQ ID NO: 241 - protein, 91 aa, Unknown
  Description of Unknown: Undetermined Phage F170/08 polypeptide
VEQNNTGKYAPFIRLIVMGISFVATGLTTIFGWEPLPFTDEQMNQGLMLVLSVGLAIYNWYKNNAVTSYGKAKEEAGKEVVGTRQDFKNRD

SEQ ID NO: 242 - protein, 255 aa, Unknown
  Description of Unknown: Undetermined Phage F170/08 polypeptide
MKIDEISKLELPNLFGKFLVVETISDGYTGTVSGHYNYEIDQKSEETYIYPVFWNDKLNKFIRSDELVVYTNKNKVYYVCKTTIDPYNHAVVDELTVEEGMDKDKRTLQAFKLFVNDLFSFGSYNIFLTGNLSLENNPDIVLVSSVSLDKQTAKMYTERTLELTATVLPEGATNKKVIFSVDKPELLGLTVSDNKATVTSKDKAGTAIVTVTTEDGEHTDKCTVQIEEYIKVTGINVSGESALEKGKTYKFTASI

SEQ ID NO: 243 - protein, 147 aa, Unknown
  Description of Unknown: Undetermined Phage F170/08 polypeptide
MAKEILNIEDLLKPETLEVAIDGKYLIVPTLSDGFTGTVAGGYAYAVTKKGTDYTVNELIYNQKDNTFKPSDEPIIITDDNEIFFITRTLEDPYNYPVVATEKLKTKDVKEKQVLQAFLAFADDRFKLGVYNVFLADEPFVYGDKTE

SEQ ID NO: 244 - protein, 98 aa, Unknown
  Description of Unknown: Undetermined Phage F170/08 polypeptide
MNDNKEKCVKQEIRDTYKGYDILLDEENGFFYVSVLDPDGKEIISGFVEADKPIEEYYKELLGKCDQDISFKDLLGFLNGRRDTERTDIRFLKRDSGV

SEQ ID NO: 245 - protein, 255 aa, Unknown
  Description of Unknown: Undetermined Phage F170/08 polypeptide
MTKIKLITKKNTQGYVMNTLLRRFYKNNVDVEFLNKFNLPDIHNHIGEYDAVIIVGFPFFESQRGALDTALSSMDNPFSKVYHLATFGDTYRNEGSFRSFVDEVISPVGHFVELIIDLTKFTNTGTKEDEQNVVALAKEALVFAKDIIEETDNYNRYEVTDRTISWVLLVDLLGENLYKVTEPSKELDTILKEQEVLVDALNINMQDYVLRTIGKMSANVINGTVVCFGYAEQHVNEVAHKLINFYKSHNYQKVI

SEQ ID NO: 246 - protein, 255 aa, Unknown
  Description of Unknown: Undetermined Phage F170/08 polypeptide
LKNNEPLEKLLDKLDEPRILQTIIIGSLQRSFNRVHVGKFNKLAQEFDLDKENLYSLKALVKEIEEDKELHELYEASMAGKITLEAVRKVLLQDDKSSFDVLSSYVVENQAVLARNREFGKLQREGAYLDHLISGLKTYLLAELKDMSSLKYINKNLKAPKVSSDRELILCLSDWHIGAFVNNIDTGGYNFEIFKERLEKLLEEVFQVAMEQDIKKIHVYHIGDIIEHINMRNVNQAFEAEFPATEQIAKGIRVL

SEQ ID NO: 247 - protein, 124 aa, Unknown
  Description of Unknown: Undetermined Phage F170/08 polypeptide
MGGNLVYILLAIAYVGEGITAFTNTKRKERYMIEEGEAPLPRSSYVFLGINYLLRIAIAISLIFIIPTSLQLNVTGIALFTLMVFVVPFIARIIEVVIRTAIVRYVQKQYIKQLEERKGKRETN

SEQ ID NO: 248 - protein, 206 aa, Unknown
  Description of Unknown: Undetermined Phage F170/08 polypeptide
MNFTEVISPNGETSLIDVNNPPTLIRRGVLSIKTKVNNEVKETPVYIVELAEELTGTDVVSVYKVKEIGDSIQKDYIEEKVTPRFKSTTYLGELAQKIKGRSIKEQRRVETKPPLFLAPVVNGIDTFTGIEGKGFYEREEDRHILLPDGKPGIAYGDNTGVFIGLSSIKWDKAYVDVESITKGYLSQKQIWFNLDGQRPQFRSETL

SEQ ID NO: 249 - protein, 246 aa, Unknown
  Description of Unknown: Undetermined Phage F170/08 polypeptide
MTDKQFYEADIQELILNKQRIFGDIGKSAIVFEKAIMQGNTICDCLVFTEKRGLIGIEIKTERDSTKRLNKQLSDYEKVCDYVYVLCHDSHVPKVEQILTRHNHKHVGILAYTEFMGEAMLGEYKQPSRSPKKSAYHMLNILWKEDLIRMLGTFRRYGDRLEANGAKVMKTNSRSGGVSGLYVKSTTARRMTKPELINNLINRVGGTEEATRVFCDVFIHNRNHPEKAIKLRHFKAKENRGDLDGV

SEQ ID NO: 250 - protein, 168 aa, Unknown
  Description of Unknown: Undetermined Phage F170/08 polypeptide
MGFKGAKYGSWNTVVGKNYVGTGGRTSGSNTKRLSTKGYYQVGFVKEYQNLTEKDIMLKLEYGKDLVSSYTGVPADMIKLRKKKEEQTLASLDTVYYVSIGKEPVGKLSIRAQRRFREVGLTFIYLEKNYVQRKLRGGNVRSVGYTNATKSQKRKADRRKSNKSKTTR

SEQ ID NO: 251 - protein, 255 aa, Unknown
  Description of Unknown: Undetermined Phage F170/08 polypeptide
MLKKGKEVTLRKFYNIITDKESVLLGARYTSSIMTTDIPITTTFEDVEVDLKKETVAGTISFRPVGERQINALSLLKEASTAYGGYGEFLDDTIEKPLINSDFAVDVSLADSAFSNLQEIPFNLYMSSPKVFYTEVSIRGRKHMQYVLEDESSSGVTSTLALVFRKKLYDGETLLGVHTYTEALARVEGIKVLQFIANGSVLEQVIGAVSVLGGSTGTTLFPMFDDMVMQFVMIESVPWVHISCDTGAIAFKEED

SEQ ID NO: 252 - protein, 255 aa, Unknown
  Description of Unknown: Undetermined Phage F170/08 polypeptide
MDYKEKVYVGALTWLGTLGERRYLGQMRDVLAVYELGSRYAGYYTENSDYDYMVVYMPSPHDLMYPTTIYKQETKIDGNKVEVKYMSIMEYVYRIENGDLEALQMLNATSSQSFFGEPIEGIDNKRTRLVTYMKELEYRRETFTYLAPEKLFRGVNGRIKATKARMDKAIENDDMEVAVKCAILIRYFMDLLVVLADGESIREGLTFSPIIANIIREFREDCESAQAKTLINTAQVLLEADREEILNSIKDHGLS

SEQ ID NO: 253 - protein, 255 aa, Unknown
  Description of Unknown: Undetermined Phage F170/08 polypeptide
MTKLEQNKEILDIFNRKGKVTDKVEESAKIMLELDHDYDFGTGDIAYTERGTDKKGRFYLESRLFIHKLMPYGFILNAVVSKVHYGDQEETLEREVSRVYELEYNLRDKVAVLIKNGKPLNFSENNISNMFSGHVAQNILEQLDTMSGSDMYVSVYKRVSRVKDEQIGKVSRFFDRLMKYNKIELIYKSGVPEGFALAYAYRVVVVGEGKVRNKWYEPVKSVDYLDKEQTNPAKHLGIPKSIFKIICEGGLEWTF

SEQ ID NO: 254 - protein, 229 aa, Unknown
  Description of Unknown: Undetermined Phage F170/08 polypeptide
MAKKEVNNSSVLLNLYNNKLLVSKVDEALDEGKPYDFIIAFCKEKFDFEINKPALSRYKEKRRESLETGVDLESLLDKRRKSGKIIDIKSKEVTPLPNETYDNTFGQVEQIYNDVEVLDTIIQKGFNSLKEVDYVEAPLAMKAIEVKAKITANQFQGLSLTGLRELRLRQSAKEQAMTEIILQFIPEEQHEEVFNAIESAEKEFYENLDLTEEDQRITKALQASGMDII

SEQ ID NO: 255 - protein, 155 aa, Unknown
  Description of Unknown: Undetermined Phage F170/08 polypeptide
MVENLREVNYKTLTLEESLHALLEGKTLIVKGLEQRRKLDVLVRIFSEGVVPVTQISYDTTPADGYWRTGYWQIYDLPINALSTYPCFIYDDLNTDELPKFMIGDTVYYTSKEDSIKDSAIVISVYKDDANNKWYYKLSRDNEIYAESEIRRDRL

SEQ ID NO: 256 - protein, 255 aa, Unknown
  Description of Unknown: Undetermined Phage F170/08 polypeptide
MANILDTLKWLDKGDKVTIEFDKERSKYAKLTLHDSSAKTNIVRNIVFYDLDKGVYAYTGEYTPVWDNLLDDMRKTQGAEPEIKTTKVNQLATYEDALKFIETNGTFYIIGEEVIVKVKDAKELALMLMYFRDAMEELRGEYDPKKHHVDMTIELSKDVLKKMAVPRHELDLSLGGLMRAVSHNVGEDLFETLGFDYMKQAWEVLVNCLSLDTIHEVPFRVLDELEKVTDSMSTTDHIVTLYAGRELKKFYSEEE

SEQ ID NO: 257 - protein, 68 aa, Unknown
  Description of Unknown: Undetermined Phage F170/08 polypeptide
LILFIFSIITMLSMFLLYLFGMASVALIELGLLMGSQNDITKGAHSLLFTGVTLTVVTEITKQCLLLF

SEQ ID NO: 258 - protein, 150 aa, Unknown
  Description of Unknown: Undetermined Phage F170/08 polypeptide
MYDSYGYLDWASWLFSIVIGSAVAAFFTLAVVGITFDVAPSHGVTKSHELHPIYENSKVVVEAKKEQFEINVDGGLVAIDAEGTTILSTKGEIKPKIVFTENYINNNWWTRFLGIAGKVKDTSSVLYLDSGTLVYNKPEKNSSAPDLKIK

SEQ ID NO: 259 - protein, 56 aa, Unknown
  Description of Unknown: Undetermined Phage F170/08 polypeptide
MSYTKRALEARGYDFDTMSMLEKMNALLELLEEPEFQEQMRKEYEEFSKECATNGE

SEQ ID NO: 260 - protein, 90 aa, Unknown
  Description of Unknown: Undetermined Phage F170/08 polypeptide
MENEKLESYFMKEIAPILDEIEMSEELIKGMENNNPSDMITVSFSKEEVDILLAMLDLELPRLDSGSELFSPNLVREAKLQLIKNKLTSK

SEQ ID NO: 261 - protein, 83 aa, Unknown
  Description of Unknown: Undetermined Phage F170/08 polypeptide
MNEQKKVYAKLTEDEAVFACELGDKIKQIRESQELSRLELAKRAKVDHSTLILIEQGKRLPTLRIMMKLSKALHRELAISFTD

SEQ ID NO: 262 - protein, 95 aa, Unknown
  Description of Unknown: Undetermined Phage F170/08 polypeptide
MRGSLDYYNYLYQTIENRPTEELDVLYDGLYKKAGDLFAIDNFQGVKEGRLILKILKAIREEINSRIDEEIDLYLYNIYDSISDEDKRVNWLYEV

SEQ ID NO: 263 - protein, 255 aa, Unknown
  Description of Unknown: Undetermined Phage F170/08 polypeptide
MFSVVKADSYVKSDIEMYEFKNVKSLALTKKEKELWSGKIAKYVNEFIVNAYGDYHGNKIPEINVVINGKLKKVLGSFVQFTNTNIHYIEISGRFVKEVILLQETPLAQRALDILMDVARHEAIHYTLCYLNSLSGGDLPTFNYHDGGEDFEKDLCLTGTSPSGATKEEYIYSSFTLGAIRCRHHSTCPECGLETYMYTRGRYYCYNGCVGDNGRKIIFRPQGDIAIYIDEPKSKAKPKVEEALKDYKGALKLPY

SEQ ID NO: 264 - protein, 255 aa, Unknown
  Description of Unknown: Undetermined Phage F170/08 polypeptide
MAYVTNIDVVADGLDLYNGNYVVERGQVVTFKLHVATWNNEPTPENAYAIIRNNGVDYKSKVDEFGNAEVTFPVNGRPDQVTTSIFALTSGYEGDMPRVMSAIFSDETEIKQTVMNVTASINGEPVSREGVFLERDQVVTVDVKATLSTGKFWEGAQVGVYNNNTEYLGDLDADGYGSVTFQVKGKQGMDTSAIYVFVKDHEREATLTVPVKFTNTTVTTETSTEESSTVDTTTGTEESSTTDTTTVESSTTDST

SEQ ID NO: 265 - protein, 100 aa, Unknown
  Description of Unknown: Undetermined Phage F170/08 polypeptide
MSQVSKHGEKRVRERVGVNKSSVDRQFELALERGYRQKELTGRLKKWVVSRVFNSKYPQTCILYNGKCFIVSSEGTLVTVLNIPSNLLKDFAKLSKKRGK

SEQ ID NO: 266 - protein, 100 aa, Unknown
  Description of Unknown: Undetermined Phage F170/08 polypeptide
MDIMDIEFLEEHKQLVKEHVEQELKLMHPLKKLQVMTDWLGDTEDKLSQGDLDYFNDLTETELIEAMDASEIVESYSDVLLDFIDYYNIDLTGLEEQLGV

SEQ ID NO: 267 - protein, 97 aa, Unknown
  Description of Unknown: Undetermined Phage F170/08 polypeptide
MDKAEKVDNIVRQVTGAIIKTTAKVAFIVFVLTFAGILVGYYSYSFLTNAGWFALPMILSVDLLYVAVLLGGLAFIFAEVYKVVLEVKKIVKRGGQL

SEQ ID NO: 268 - protein, 59 aa, Unknown
  Description of Unknown: Undetermined Phage F170/08 polypeptide
MSNKTLEQRVIDANKEINDKLNESSIIRKQIEELEEQEAILLSDVEDLLDYLENIGVDL

SEQ ID NO: 269 - protein, 121 aa, Unknown
  Description of Unknown: Undetermined Phage F170/08 polypeptide
MNKKVEEMTMEEKDKALIAMGLIDVTQEADWVVLATCEECREEYEGEEYEEGDCAECEHCGGEYFMIETALEGTRCGRCDDYFDMWDDYFEFENEGNPYKDKHICEHCYEELVSMGMEEKF

SEQ ID NO: 270 - protein, 125 aa, Unknown
  Description of Unknown: Undetermined Phage F170/08 polypeptide
MNELEELKNTLIRQKLSMLESYEMREASFWIMFNGILRTIMSVAVVAFVSYAKHVRPDNVATWFLALIWVIFLAEGAKGAYDAIAFGIHRKKFAKHIKNMRGIITITQLLIEEDEEKLNGGKLDE

SEQ ID NO: 271 - protein, 76 aa, Unknown
  Description of Unknown: Undetermined Phage F170/08 polypeptide
MSKDEKLVEWFVVALMVIVWLLITFSILYTIVSLPFMVHEGDWLGIVRNVLLDIVVLVIGVVATWLQLRFKKGMEE

SEQ ID NO: 272 - protein, 124 aa, Unknown
  Description of Unknown: Undetermined Phage F170/08 polypeptide
MGYLESAIEEIERVLLGNKSRDTEEVYLNNAIRYIKKELKKKEVEPTWLNEPQTLFLNWFNELYAVGGLTHVTEAVGFLESTGGRMKYPEAYSAFSNLSENELLEVYSKFYTGLFLKAQGGELE

SEQ ID NO: 273 - protein, 85 aa, Unknown
  Description of Unknown: Undetermined Phage F170/08 polypeptide
MNFHGKVFHDKVFDILSRDYPDWQRYQTEKRPHPNELRKDFAIDSTDSRYEEYVMGEFNVETASGDVKVYAVGIRRVVHKRAEEE

SEQ ID NO: 274 - protein, 197 aa, Unknown
  Description of Unknown: Undetermined Phage F170/08 polypeptide
VEYTEKDIKEGMKLRCTDNSNVGYWEVDKVYEVTRNKDLGLVIAGEGERSHRTVKYILEVLNGDSKIKFEVVEEKPVRFAKVTCVYPPDRGLVEVGHCYEVLKEFPTGSVRIYLNSKLGNHSLLPDQFVFVDEPSNDGEKDVEELDVEAKILADIEQLKTEAECLFAKRDRVNEQALNLNAKARKLEESLEVLREYM

SEQ ID NO: 275 - protein, 255 aa, Unknown
  Description of Unknown: Undetermined Phage F170/08 polypeptide
MIYYINFLEDFASSWSADKRYRVRRIMTTGSYAIIDNYGHVRFSSDTARGVLKNIEQEYATNKVELTLVEEEAMNKPRFKVGERVKVSNDLQAFGIEYKTHIASKMLGYAGKEATITRVWGSNVRYFINIDGTHQDWCWTEDMLDKIEEEPTLSVRCVEAVHPFWTKGKDYEINLTSDGRYRVWDDEEDGSSGKSIKELLDVINSSGNKFELLDETPSEAEPRLNHDMSDLEKIEAKITALSEESYQLFEKSEEL

SEQ ID NO: 276 - protein, 100 aa, Unknown
  Description of Unknown: Undetermined Phage F170/08 polypeptide
LNKKETLLNTTVTFLGGTSQSSRPKGKQTLCEMQKSDGSVEFIFDGTVFYVHSMVVVYMANKKHSMQATVSAIDGNYKYAGITFKLKVDYKENTLLLEEI

SEQ ID NO: 277 - protein, 209 aa, Unknown
  Description of Unknown: Undetermined Phage F170/08 polypeptide
MRKNVICRLECVSKDKDNLGEWTVDNIYPVFESELGKVYILDDEGTTCSRDSVSLIISSMASFGVTFRVAKDKAEDPIPSNPQSSTSLEIVKGYEHLEEFIDSLSSNQRVVSHSVDPNSQWHYIIYETKSAELGGVTLEELLDTLVYNVHVVVMERSKRTYEPLESHTFKWEYGTKNTEDWEKIVPLLGYKVFNTNLNSNRGFHITILK

SEQ ID NO: 278 - protein, 52 aa, Unknown
  Description of Unknown: Undetermined Phage F170/08 polypeptide
MYFVIVVNGQHRTLLKVTGKEWEMSPHTEEAVIEVALDTCYTYIENQEAQKN

SEQ ID NO: 279 - protein, 46 aa, Unknown
  Description of Unknown: Undetermined Phage F170/08 polypeptide
MIGDFILWFKQAWKETFCIHDYTVKGVYKTLDNHGYLKCKKCGRIK

SEQ ID NO: 280 - protein, 110 aa, Unknown
  Description of Unknown: Undetermined Phage F170/08 polypeptide
MNQRQIKKRMKKVLAILNEVEVVDSDYDSGMVLYVDVADNEQNRDIIKEVCGILGLDKEKFIAECKESRLYEETLNLASCWHYLMQKEPKKLTIWHSVSKGFSLERYSED

SEQ ID NO: 281 - protein, 213 aa, Unknown
  Description of Unknown: Undetermined Phage F170/08 polypeptide
MFKKDKKEEKTYREGDLLKTVGGYYPDARLSLGITYPLYKTTNEGWYIINNEGSRVTLIEMDALGIDYAVMEEPLLELKEGDPLLVVSDLKRGVRGLAGAEVQCLNITGEMASLAGTVVHYDKDMSHIAKGLFTVKENDSYWCVAIAIPLNKVADPDFALEHLLATLNKKASTKRLILNEIKYDLNLLHQELDEVSNELEKLTKNIETIYNNR

SEQ ID NO: 282 - protein, 147 aa, Unknown
  Description of Unknown: Undetermined Phage F170/08 polypeptide
MSMPSDLGKTLKKPIVINKNPDFYELAVGGKVIYNEEVMEIAKAFSNKKTKYYLLNTRSNKQVCVPVYHVRPYDTQVEGLKLGDVLDAMHIMTTVTLRAVNKHGFVVDEDIIECLVDDVPENALIVTSEVSRIQPEDFGKVTIDYFV

SEQ ID NO: 283 - protein, 143 aa, Unknown
  Description of Unknown: Undetermined Phage F170/08 polypeptide
MSYVNEFETIGDWLDREIYDVLLRDGHDIDELDNWGMALFALSEGYVLTDGLDKPFLELTREDLVAGYNHFKEELNGWLRGGKLLEVSGNLATIQGFSFDHDDVLFLEDNNKAYAMLVGIIIEARDTYKNGFCKGYYVIPYQD

SEQ ID NO: 284 - protein, 99 aa, Unknown
  Description of Unknown: Undetermined Phage F170/08 polypeptide
MNKYKFTYADIKNLSEEEKEKELKNRCGVLAVECLSTKQLQKKKPRFMVFLNTVIFDSTAETGGQYATATVKTEPIGDGRFRVCDGWGQLSNGIIELLK

SEQ ID NO: 285 - protein, 96 aa, Unknown
  Description of Unknown: Undetermined Phage F170/08 polypeptide
MFKRLEEYRKNLSNEELKIFNNTMKLLNDNKTDFQERTKNFDKELQYTELENEKEKILIVLDTIRVSNENYKNVISENLYHSIKEMTIIFELLYNL

SEQ ID NO: 286 - protein, 107 aa, Unknown
  Description of Unknown: Undetermined Phage F170/08 polypeptide
MNELEEVKEWNNKIEEQQEVLNKVIVTFYKEIDLKVKMVNRGLLGQLSAFNELKGMLSGIELTAKVIAPDNVLPITTHNFLEYLFLGDNEQRAYAKEYLDGFLKSVE

SEQ ID NO: 287 - protein, 46 aa, Unknown
  Description of Unknown: Undetermined Phage F170/08 polypeptide
MMNGLKRLMKAKRYKKEVKEIITMQKKAINELETLNKNLKLINQNY

SEQ ID NO: 288 - protein, 88 aa, Unknown
  Description of Unknown: Undetermined Phage F170/08 polypeptide
MTKEELKSYLENYNKPFSTSMDNVFSLFINDVRAVADDFRKGEAFIYTCAELIEEQAETLEKSDLEELEEKSGESLVIQDINGYLYFV

SEQ ID NO: 289 - protein, 75 aa, Unknown
  Description of Unknown: Undetermined Phage F170/08 polypeptide
MIIAENELYLVKNPLNEWDMNYHLIEKETGKDFLIDIGDVADNEEEREKYELGLLFSDLKNLIVDLLIEYSWKTI

SEQ ID NO: 290 - protein, 97 aa, Unknown
  Description of Unknown: Undetermined Phage F170/08 polypeptide
MTEQQFKKEHLLEPTEWRSGGYLDTSLIDQSQSYYIESRPRVYGGCYVYQYVTMKDGTVYELYSMTASTRGIVAHNCHARNVLQRDVKQYRDSAIHY

SEQ ID NO: 291 - protein, 68 aa, Unknown
  Description of Unknown: Undetermined Phage F170/08 polypeptide
MKLSDIILVGLLVSIVLLWGYLSIMICLQVFRALGGWDIRTLTVCSGLLFAYVFGLKGIWEQGTGKSK

SEQ ID NO: 292 - protein, 80 aa, Unknown
  Description of Unknown: Undetermined Phage F170/08 polypeptide
MKLNVIHLLFCLFQEQESYSILSYESIDEFYSRLGYDLESEWLLRDLGINGTSGLAELLTDYNNLLENEITKAVFSDKWL

SEQ ID NO: 293 - protein, 81 aa, Unknown
  Description of Unknown: Undetermined Phage F170/08 polypeptide
MNELECIYDSRKSFYGKANLVEEENGISLYSYDTKVATIYTNGLAKVFGTYSQTTLRHIKEFFKQNGLKADTKKQIEKDYL

SEQ ID NO: 294 - protein, 76 aa, Unknown
  Description of Unknown: Undetermined Phage F170/08 polypeptide
MLKITKEITLGEFEAWEGGKDRLETIKELDILDEAQQEIELMIEGAEEVTEMTINDILWFEMDEFIAQFEEEEEEE

SEQ ID NO: 295 - protein, 68 aa, Unknown
  Description of Unknown: Undetermined Phage F170/08 polypeptide
MTTEEKALNIAENKGITDYKVKGNVLSYYTSYPMEKCTYLVTIDIETLEEERKELKKYYKKGLQNACL

SEQ ID NO: 296 - protein, 56 aa, Unknown
  Description of Unknown: Undetermined Phage F170/08 polypeptide
VAVTINNRIKKLQYERIRKLEKRKRGEPPEFIFNGNYSLEEIELFLHFRKKSEGKK

SEQ ID NO: 297 - protein, 98 aa, Unknown
  Description of Unknown: Undetermined Phage F170/08 polypeptide
MTKTELQYKKAIGVAIFATSEEDKKQLGNVAPFSIYEILEIDLNKNRVYYALNCGERHAVCFTKLRKEEETGDNFILINKQPFFLKDIHKGLTWSKSL

SEQ ID NO: 298 - protein, 76 aa, Unknown
  Description of Unknown: Undetermined Phage F170/08 polypeptide
MKIGKKEELEANNIFNRADELLGAVTMEELERDNGGSIFYADGSPDTVLWHMKKEFSLKPFHCYYFDGWYIALINI

SEQ ID NO: 299 - protein, 144 aa, Unknown
  Description of Unknown: Undetermined Phage F170/08 polypeptide
MTKENNVFLNEKELMKEIIETLENGFDGCYCDLHNEVFNYGTNTDTEELEEYGIFNAIGEIQEYEEEHFGATLTDLGNASAVADMLYYIKGHEFLFDRLDFNDVLADVAEGLKLDKDLWNEEATEEVNKAIIKCLKREVPWLVD

SEQ ID NO: 300 - protein, 143 aa, Unknown
  Description of Unknown: Undetermined Phage F170/08 polypeptide
METLENFGYTWQGIKEVTKEEAEKNVKNGVDTFLLYPDNTESLVISLDELETEGVRFGVEKPVQLLFKVSNSYHNTEEVYYGENVEEIEKKLHDSLEITAENLTGQEIEEDWENYYKTYEEAWEATYNGILSQLKSECTIEKM

SEQ ID NO: 301 - protein, 65 aa, Unknown
  Description of Unknown: Undetermined Phage F170/08 polypeptide
MKLTEKELNTILRDDETGNGGTAFLGETLADFLEESGIDFTNLTILEVNELLENNGIRPIEVVPC

SEQ ID NO: 302 - protein, 65 aa, Unknown
  Description of Unknown: Undetermined Phage F170/08 polypeptide
MLKNIKKSDKLTRKDIQGFWGDEAKTLEEWYKSISKESDTDKMINTLKEYANNNEFHFVKGEQGQ

SEQ ID NO: 303 - protein, 101 aa, Unknown
  Description of Unknown: Undetermined Phage F170/08 polypeptide
MTNTNNQQWNQKFNDGTMNQNNQQKEVITLQVAESFVSQILTKEYSVIGLVILMFYFMFGMFGIFGGAIYIAFTHTNRKIGAWQQVRSVYTIKEEQEEWNN

SEQ ID NO: 304 - protein, 63 aa, Unknown
  Description of Unknown: Undetermined Phage F170/08 polypeptide
MEQLKGLTIRELIKKLEEVPEENKDLPIYTFENENSLPIKGISLYDENGKHSQENPLSFDVIR

SEQ ID NO: 305 - protein, 119 aa, Unknown
  Description of Unknown: Undetermined Phage F170/08 polypeptide
MNSFMNKQAKQVERSKEIKLVEEVRRENVKKRFSEEVKKYLEKGYTIRLENKVFPFALISIDLEKGEKVISLILVNEYDGIANYTVMKKVTLREKGNRAILKRMLTDKDVKVVSMWKGI

SEQ ID NO: 306 - protein, 88 aa, Unknown
  Description of Unknown: Undetermined Phage F170/08 polypeptide
MKLKEFIKLAESKGATLEAYNELGGYELTRGDIVDQNPVLIAYMQGTHSVEISNEELENKELTELAFVYKNASFIYPNEKELLSGLGL

SEQ ID NO: 307 - protein, 55 aa, Unknown
  Description of Unknown: Undetermined Phage F170/08 polypeptide
MLEVGKFVRGNNGARTWVGQIVGIDRLAGEYRVRDVVTGIYFYVSCSAVYECARP

SEQ ID NO: 308 - protein, 58 aa, Unknown
  Description of Unknown: Undetermined Phage F170/08 polypeptide
VDTVTDIIDVLGIIKQDIEYKGERIKELEGQGKQEQAELLEAEVKGMREVVQDIEQAL

SEQ ID NO: 309 - protein, 58 aa, Unknown
  Description of Unknown: Undetermined Phage F170/08 polypeptide
MNNNKLDELLEEEYSTLDELLDSKEFKKQMNNLNHVPQMQPQSHNSNTLADTGRYPEK

SEQ ID NO: 310 - protein, 44 aa, Unknown
  Description of Unknown: Undetermined Phage F170/08 polypeptide
MTIEQINAEVKQQEMLGNKLEVIQLGNDIYMYINGEPYKTIELI

SEQ ID NO: 311 - protein, 52 aa, Unknown
  Description of Unknown: Undetermined Phage F170/08 polypeptide
MTIEQVKDYGKAYGKELSTKEVKEFFEKHNDMPSLMDLAKFCGAMNEDGTKN

SEQ ID NO: 312 - protein, 79 aa, Unknown
  Description of Unknown: Undetermined Phage F170/08 polypeptide
MTPELAEMNLTKNDSPFSFINESGVFIEPIKNPFSCEGTYLQACKDVAGELETNKEVGNEIDNYLKMQNWLNKLAYEYI

SEQ ID NO: 313 - protein, 74 aa, Unknown
  Description of Unknown: Undetermined Phage F170/08 polypeptide
MKSIIIKQIKDGYKGILERRNNGWADEELNSYTTGVSNTLFELINDLQDNGVISEEEAEEIEEVFSNTIDILNF

SEQ ID NO: 314 - protein, 231 aa, Unknown
  Description of Unknown: Undetermined Phage F170/08 polypeptide
MTEWANMNKEEVLELLNDWFGVSDYDTVMGELEEMKKVTFTGSTNQPLLGGNNDLIGLPQFFKDNEAESELPTYEELLEELEKDTWNLEAEDNTYNYSGFLESESDFKVIQAENSDTTIAFFAIHTGIDIRAGYSKAIPVIFETYYDFQEFLGNYFYSQGYYAFKHDNKEYTISLDVSATSEYVRIYITDNNNNELQLDYEQETCMELDKESVAEYLTSQGIEFKDLKPAL

SEQ ID NO: 315 - protein, 64 aa, Unknown
  Description of Unknown: Undetermined Phage F170/08 polypeptide
MSRKYRGFDTAFTKDGVCVYVIKDDKEKGTALVRDTRGGDEYTVSNEGMIYTKDMESIDVYMPW

SEQ ID NO: 316 - protein, 49 aa, Unknown
  Description of Unknown: Undetermined Phage F170/08 polypeptide
MEINKAYERLLKEVELLQNDLMDIEDYSEEVYQAFQKVIDELEYVIEEG

SEQ ID NO: 317 - protein, 75 aa, Unknown
  Description of Unknown: Undetermined Phage F170/08 polypeptide
MLNSRGEPLLPINTQVRLNNFTFECNGRGRSPMGRVIGYDNSVCKEFTDYYIVESGDLQGYAHYTNVTEVVLGGT

SEQ ID NO: 318 - protein, 90 aa, Unknown
  Description of Unknown: Undetermined Phage F170/08 polypeptide
MLNIFYNVWGGFISHPVLITLSIVGIYVLGYALVKFIVGIVVLSNSLNTKWVIASAIFTTVLSIVFTIYSFLVEIYVVLVVISGLVVLLT

SEQ ID NO: 319 - protein, 106 aa, Unknown
  Description of Unknown: Undetermined Phage F170/08 polypeptide
METTLIDKERLNKLKVGDTIFTKPELRDPILGCDKATVTSVTPGSVWISLNGTEYEVHKDEKTKVPLYRNQSGEIVGEYFLDFADFHKYWTYFAKTMVEQVSLRGE

SEQ ID NO: 320 - protein, 103 aa, Unknown
  Description of Unknown: Undetermined Phage F170/08 polypeptide
MDKNTKDELANALGKFFGTLVLVVLTLVIGGYVTMFLWNGLIAPTFGVLTLTWAQAIGLDVFISFITAKTTTNTEDSILMVFAKATVSTLLFMLIGWVVMFFI

SEQ ID NO: 321 - protein, 87 aa, Unknown
  Description of Unknown: Undetermined Phage F170/08 polypeptide
MKYLIYATLVVYGLITLLTSYILTYGVYWQLTNELSNPMPWFVIVLCGGIVLVLITAFIILVVNVIQLNKIENQEVNIAIIKEENDG

SEQ ID NO: 322 - protein, 101 aa, Unknown
  Description of Unknown: Undetermined Phage F170/08 polypeptide
MAQCYHDQLTREEEKQLKRKYEVLQSGSCWHCNKPLWMYPPDRVVNLTTQLDLSIPNEYTVPTRLHYNPITGERMGLVHVRCDYYLKELNNSLLNHSMEGK

SEQ ID NO: 323 - protein, 63 aa, Unknown
  Description of Unknown: Undetermined Phage F170/08 polypeptide
MKLKDLIKLMKPGVDVLVTYPTAGATITVRTKIGSNNEVLEPYLDYEIANVSKTNHYIAIDII

SEQ ID NO: 324 - protein, 74 aa, Unknown
  Description of Unknown: Undetermined Phage F170/08 polypeptide
MKVEQGELAITLPQNPEENATATIYFSVDDYGDIAITTTGEEGYTQFDFNFTEEQWAVIVDTISVQLRAQKLSS

SEQ ID NO: 325 - protein, 83 aa, Unknown
  Description of Unknown: Undetermined Phage F170/08 polypeptide
MEKPYVAVRSIHTGRVEYCTEDWLFCGSERNAMPCKEIRYVDMLHCGMESYYEVTFKANQYTYTEELPVYAFTGIKMIEKEES

SEQ ID NO: 326 - protein, 126 aa, Unknown
  Description of Unknown: Undetermined Phage F170/08 polypeptide
MAKKVEIPSFVARAIKKYDSMLSLLANEYFDPYDEAPDDKLAEWIDEGNQYVLARAYMYGYTIKRQFKVIGDTRYDHGFTIGDTVYLEKVYPDGVYAVRGNSRHSLKIVTLDVHPCDLEEITQEEE

SEQ ID NO: 327 - protein, 65 aa, Unknown
  Description of Unknown: Undetermined Phage F170/08 polypeptide
MGHLPDDVGSWATHCINLVCDGELLEDKKSQTYTCEDCGEVVTLDELNEHLEKEAESYLKFFGYK

SEQ ID NO: 328 - protein, 171 aa, Unknown
  Description of Unknown: Undetermined Phage F170/08 polypeptide
MDKNEFINLLGDEIFTQVGCDGTLNPHALGYNAGIAKAVSLAYGLDEPEKVVIPYKVGEYIDKCKEENLTFINMIDKGSYPSKMYFWLANNPENHEKLAKAWVLGHTVEEEEDEYYIIIAKDKDGWGYSYIDRLGSPDFTNYLKDIPTFTEKEIRKMDERFMAFAVKVGDV

SEQ ID NO: 329 - protein, 82 aa, Unknown
  Description of Unknown: Undetermined Phage F170/08 polypeptide
MSYEITYDSNTSVNIQEKIIAVNNSALYKVCVEKKASRVNEKTEVKYTLEVSSAESQESTKLELPHEVMLRLSELIENSLEF

SEQ ID NO: 330 - protein, 180 aa, Unknown
  Description of Unknown: Undetermined Phage F170/08 polypeptide
MNKQELINALEELKFSHVPVVQELSNRSQCYNEAIKAAILLAKKLDEPKKVIVPKFVAEWYEGNKHALDLAIFTQIRMLDGNSYPHESEFDCWLDQSKNNPIETLIRMKDGYEVEKEPLYHIVFTGLGNKGEDCYLWVDKSHNNEVYFSNKPNMGKNKFTEQEIKEIDERYWAFAVPVYK

SEQ ID NO: 331 - protein, 130 aa, Unknown
  Description of Unknown: Undetermined Phage F170/08 polypeptide
MIKFKEFDVGDIHYEEQLEKFQNEHPSAEFVTITGGQTTYEKIWFKYTDDKVAQVELSDNQQIVLGWLKEKYTLTDIEPIELFWRLRANSIKPDYRNSPVYKNYRYMTEIAQLQVLQAFSQWAIERKERN

SEQ ID NO: 332 - protein, 118 aa, Unknown
  Description of Unknown: Undetermined Phage F170/08 polypeptide
MSRQRYNEIIDRVCYMYMEANGEINFPNSFEGDLLKIAYKTAVEAVKKPELNKNQKQVFEWLKVGYCSKDSLFEALERIGETYEDPKTEEAYYSLSVTEEAQVIQAFTDWFLEQEGVQ

SEQ ID NO: 333 - protein, 56 aa, Unknown
  Description of Unknown: Undetermined Phage F170/08 polypeptide
MRKINVYIETTWAGIGEIETVEVPDNATNEEIDEVARDVFSSYCSFGWGDVEDEEE

SEQ ID NO: 334 - protein, 180 aa, Unknown
  Description of Unknown: Undetermined Phage F170/08 polypeptide
MDNKFATKDDRYLVQVIVNGEVKVSKTINGLAQAKAEKERLTKHNRRNLVIDSEEYRDQQNNLYGSRGGRHTVISINLQKLNHQVEGNELNTIIFDLVSKLEVTHNLKIAPTYFKAVKEGRKLFEIRKNDRHYHVGDILLLNEYTCGSYTGEFVKAKVTYITDYAQKDDYVVLGIKLCEK

SEQ ID NO: 335 - protein, 154 aa, Unknown
  Description of Unknown: Undetermined Phage F170/08 polypeptide
MKYTCIKPFKTERVSVDVNSVWYGVDVNNMWYELDDPCYPDIKCPKYILIGGSAGASICIDLHTLLNNFMKVDNSYESVEIKLRERGIFGKEHTITFDYMGYAHFKQRFLKRFGNISSDRKLKKEIVNTNSLNDLERVFSNNDNWSIKIMKERY

SEQ ID NO: 336 - protein, 156 aa, Unknown
  Description of Unknown: Undetermined Phage F170/08 polypeptide
MVINRYILCIKSLSMEDMRYVVEKVSSKTDFGGLSEDCLLPQLYRPITLVFVPSKKYVYQSLGVTTYKDEKALVYSYGTDGDGLDQLLKDIEEAKKVTTFEEGLKRRYNRQIKRKTKRINNLLEQDKRGYGWHELGYLQGVVTTLEDVLDDLEERQ

SEQ ID NO: 337 - protein, 121 aa, Unknown
  Description of Unknown: Undetermined Phage F170/08 polypeptide
MSNCIEELLSKEAIYVDRFIVARDNSYFANIVMQSFHTKNVFHVKRNDEYFMGIRANNFVVELGELDFEVPISKEDHELLASVLGTKLDTATFVLVTGNHKGVRYTTIWAIPKTILDKELL

SEQ ID NO: 338 - protein, 59 aa, Unknown
  Description of Unknown: Undetermined Phage F170/08 polypeptide
MIECLMCQVPLEETCGDFYLDEMLCGLCAMHLLLDGIEQSLMMEIYVSELLLEEEENML

SEQ ID NO: 339 - protein, 172 aa, Unknown
  Description of Unknown: Undetermined Phage F170/08 polypeptide
MSKYILFWGHTPSKRNKLGKECLSQWYPSQFSAPIKGLGEDIIFPTAEHYMMVRKAMLFNDVDTAKRILKTESPKDAKRLGRQVKNFEENLWVKHRKSIVLDGNTYKFTQNDSLRNFMLSIPKGTKFAEASPFDKVWGIGLRESDPRSRDTSKWEGLNILGEVLTEVRENLN

SEQ ID NO: 340 - protein, 157 aa, Unknown
  Description of Unknown: Undetermined Phage F170/08 polypeptide
MIKVKVIDSDTPYGLSKELEKFLANHKHTSINYSVAYKNPSTIYSALVTYKQEDVSVDSLVPLKAKGFLKIISFDKYRTLEECHRRVPLSTYKLNLNDGDKIPLFFKDKPVIAISPTGEEPYYFYEHPEHIEANGGLPSPHFAFEHKGNYYEYWEEH

SEQ ID NO: 341 - protein, 235 aa, Unknown
  Description of Unknown: Undetermined Phage F170/08 polypeptide
MCFGYICPVCETAIVGDPDNGGELCQLTHIRHSKVIGTTRGHYNGLGGVVEDCYFGGRSGRNSQEEIFRSEYEFKDSYRIGKRRQAPSGREVRAYEPLNDLTVGSPERECFEIAIEGLNKELKGYANTILALEDELLQSAIGGLSCMGQDYYEKMMILANMKSSSNRYWLVLSKLYNDYILTLPDSMEAKSGVIAVHVACLKTLSKEERASLPFSKPDPDQSIGTVREAYREDNT

SEQ ID NO: 342 - protein, 146 aa, Unknown
  Description of Unknown: Undetermined Phage F170/08 polypeptide
VEFVEKAEYVFPKPILDFNLGHRVAIVLKEEELSCLERSYYKTRLYGSIYLVASDKISIEVYNESIKLGFNDEEVLGCVIGYPVECAKWFAKASREELSNSGVMMSGSYTFKCPEHLVDYAKEYMLEHYGLKAYYDIPCEKIVTFS

SEQ ID NO: 343 - protein, 44 aa, Unknown
  Description of Unknown: Undetermined Phage F170/08 polypeptide
LNKQRENHKEKIKEHTEIIGHIEEKIENILYIPEEEEYNRDLPF

SEQ ID NO: 344 - protein, 31 aa, Unknown
  Description of Unknown: Undetermined Phage F770/05 polypeptide
GILLVDSQQALECCALSSQWGSGNNGIHHQA

SEQ ID NO: 345 - protein, 142 aa, Unknown
  Description of Unknown: Undetermined Phage F770/05 polypeptide
MQVDVPGKERISALSVRGTVLILDGQEHDFAPIWDGGYLPPEAYIGRTPFQEIKVVDGDVFVRYIHQVTVEILDAEPGEVKPFKVTEDGPVEMPFEYYRLGLGTNSERSGDGEVPGSTEYGQEPSGESLPGGERADSDRIGS

SEQ ID NO: 346 - protein, 30 aa, Unknown
  Description of Unknown: Undetermined Phage F770/05 polypeptide
MDKGEVADLTAWLEKVKEIQERYPLPEEPK

SEQ ID NO: 347 - protein, 174 aa, Unknown
  Description of Unknown: Undetermined Phage F770/05 polypeptide
MTADQVFNQVLPEAYKLLPASMNSPEASVMLLAIGLQESRFASRRQLVNSINSEGRKVLLPLGPAKGYWQMEKGGAVKGLLNFWKPATKELVHSVCKARGVPATQDAVWDALEHDDVLACALARILLYTDPHRLPPIKAQAEAWDLYLRQWRPGQPHEATWPELYRKAVRVVTQ

SEQ ID NO: 348 - protein, 170 aa, Unknown
  Description of Unknown: Undetermined Phage F770/05 polypeptide
MTISARQIRWIAEVLLFAIIALYAYNKGFVKAESKTNAEWELRMMQAERAAEENKKALEQSLLEAMNEVKKDADEQLADQASRIAAADAQSRSLREQVARLRDDLIADGARASTERHASNAASVVLADLYGSCVSHRQELAGALDRSHAAGLTCQKSYAIVKSLGHAPPQ

SEQ ID NO: 349 - protein, 185 aa, Unknown
  Description of Unknown: Undetermined Phage F770/05 polypeptide
MSKYEPVFDSSKVTRFYHVRGFAERNGRQVRFFKTTWVGFLETDRAYWVVDEDDLKELEHVVRIRKITAASDIRDLAKERYGAFLALKDGSTKRARTSVKAAFFSMICRRERQLTFLERDLNRAQSILLGTRLDTKVAERLEMLNTTTVEIPSSWDIDQQILAEHKRIHENEGHEEGALVWEPDF

SEQ ID NO: 350 - protein, 63 aa, Unknown
  Description of Unknown: Undetermined Phage F770/05 polypeptide
MAEVITTVLEMPNTVIATAVGDKIMEADAYRHYLESINVDPRFVLEEYIAMVAEKDQEVWKHV

SEQ ID NO: 351 - protein, 105 aa, Unknown
  Description of Unknown: Undetermined Phage F770/05 polypeptide
MPWKSDPNIWGVLSAIALSVLSGVISLTSRIAKGHPPKFVWVVSELSSAILVGYLIYDVYPVIQHLLYEWMTMPICIAVGGHLGGRVFQWVEFKYKEKFGIPDSY

SEQ ID NO: 352 - protein, 74 aa, Unknown
  Description of Unknown: Undetermined Phage F770/05 polypeptide
MNYYLLYLALGAAWFFVAIGHIFRVPSKQTVERIITPPILISLSFFSTFMFYVFLWPLALLIDIWRRMIKKSTT

SEQ ID NO: 353 - protein, 255 aa, Unknown
  Description of Unknown: Undetermined Phage F770/05 polypeptide
MSNKVTVVGAVLDERYLTLYVKGSAEQIRIPQGDPRVAVFVDKYVPILSQGGEVDYSEDLLVINNVYEAAEKKSGGIMRFFRVAKKKVAEFFSAASASEPAAPVAPVTAGAVPGDCAPDTDAGQDVGEEVAEKVTIKDPALAKAVDEILAHAVPASAPQFSSVDLENLSEDGVESEDPDDDVGEGDTIIAVTDQGTIVPDAQKLKTQLTAAVQSKAKGSTVGIENFLRRAGSVAAKRQHSVQDLMRFIERGDLPI

SEQ ID NO: 354 - protein, 255 aa, Unknown
  Description of Unknown: Undetermined Phage F770/05 polypeptide
MQVTHQKDYATHVVIGGKQAISMGISDDPAFFQVLSSSLYTDKILAVVRETLCNAYDAHKMVGIEKETPVEITLKDDEFVIRDFGPGIHPDDVGTIYGVYGGSTKKHDGSQTGGFGLGCKSPFAYVDNFQVTIHHEGKTNVYRMQKASIQNGGRPAITPVVTDIPTDQTGLEVRINIKNEDVRRFGTLIRRIVANAEMLANFNGVKLPTLPFSQVTEDWSIATEQVLEYNGHIICVRYGDVIYPVERDEFIAEVY

SEQ ID NO: 355 - protein, 63 aa, Unknown
  Description of Unknown: Undetermined Phage F770/05 polypeptide
MSLDGQTVAVHIVMFTNYFGYVPGKKQIDHLCGQRLCCNPAHLEMVTHLTNQKRRAKRAKSKE

SEQ ID NO: 356 - protein, 132 aa, Unknown
  Description of Unknown: Undetermined Phage F770/05 polypeptide
MAKKAKLKADWTPGKLGHAPVNGRYFFVNRETRMTHTWTIGQLPVPEGYEQVTMQEYDSFRKFNGTLSKKKLMAFIRGEAKCSKDAGKKSGSESKPAAKSKTRASSSTTSPAPATSGKARIQVRAGVVVTGG

SEQ ID NO: 357 - protein, 46 aa, Unknown
  Description of Unknown: Undetermined Phage F770/05 polypeptide
MIKHFGGIEEAEAAIASGKAVYGKPTVPKGYILGTDIKGMYVLHKE

SEQ ID NO: 358 - protein, 189 aa, Unknown
  Description of Unknown: Undetermined Phage F770/05 polypeptide
MNAAAFGLPATLREVSTVLKAPDPRSMKYRRLYMSIATNAAKQSVAERHQVGGVLVTTTGALFTGWNGTMPGTDNCCENGEYLREETRFKTTPYGVIHAEHNILAWASRSGVPLDNSVLWITRAPCVRCAEMIATHGVHLVLFRDDHDEPEGMTVLAMGNVKAMSWSTLDSLITEHGGHYVVSKTLLAN

SEQ ID NO: 359 - protein, 255 aa, Unknown
  Description of Unknown: Undetermined Phage F770/05 polypeptide
MKYITWEEQDSYPVAILIKEAAVSRSAAESTYIKQLEGLGVPRKNVIVISLDYEGKKVSAKAIKECIKDRDQLLRDLGVQYAYVADSKYFKEWTKRKTDADFGNLSPPAGYDPGYLVTPGVNHQVLLFDPGQMHRLSRGFKAIVDHAHGVYRPVGSDLLHDVTYIYRGHVSQAKEALARLMDKPEISCDIEGFSLSMFDSGIATIGFAWNEHDAVQIQCDYREMIQDENKHHGYYEPNAEMREVLKWFFTEYPGR

SEQ ID NO: 360 - protein, 175 aa, Unknown
  Description of Unknown: Undetermined Phage F770/05 polypeptide
MQARTPEFLIFKRAVKDCLDGFLYVPVRKAFQAKLNELIIADAVARGDGIRAFCHRGRNFMIPGEKPNFRYFPRLSRGNRVLVDSLLSEYDPVLIDERDSVLTFISQVLNKSDEPSEYLKMFPSGLREPLKRVYEHFGLPVEGVEFPTESPIGSNQAGWDKLCTRVGINLVLGGL

SEQ ID NO: 361 - protein, 255 aa, Unknown
  Description of Unknown: Undetermined Phage F770/05 polypeptide
MVDSPVQQEIELESPVRASDHVRSEGVDKPAPFVLTPGQEAGFQTFINFYSNPDAQVMVLKGWSGTGKSTLIRRILDEMETLDRALSTLDDNFEPFEPLLTATTNQACEALAVAMKEFNHEVKTIHRALGLRLRTDYKTGKSELMPISRFELPYRCLIVVDEASYIDPALLQFCFDRTDCCKFIFVGDDCQLTPVGTNIMPAFAMKDIVVELIEVKRQNSGPLLDLCNAFRHTVKTGEWPKIQLDGDQLIHVPRD

SEQ ID NO: 362 - protein, 255 aa, Unknown
  Description of Unknown: Undetermined Phage F770/05 polypeptide
MTDRSAEDIALSKAKIRIIGDSKVSFYANIMMGLKYVWEEGMGTAAIDGITMFIDPKFFMSLDEMSRKTVILHEIEHVWRHHIGKVRMGDRDPMLYNIAGDHVINNNLLACGYGPISWTDYRTGAKCNWVCDPKYANMSTEDVYADLYQEQQTQGGGGLSSSTQGNSGSGNPVPFDDISRPAPAKDDGTPMSETEIQGAINDLILSAATAARANGNPGSIPGEVQVFIDSLMFPKLPLPHLLRQFFQVVKRGGFT

SEQ ID NO: 363 - protein, 172 aa, Unknown
  Description of Unknown: Undetermined Phage F770/05 polypeptide
VSGRWELFMVRQEDLTGQAIVDEYANSDSPNRLLTGDFEGWRVSIYEKGIQKGIKFGTKSVLEKLASEFCPYVVTVKPPDGSYVTPGLYVGHCRNSESQYNQSYSRLGGTAASINEVVELIRITNPLNGHWIFDEEEVFVAQSLAVPSLIPETHNQVEWCKFAKAMAIIGGE

SEQ ID NO: 364 - protein, 255 aa, Unknown
  Description of Unknown: Undetermined Phage F770/05 polypeptide
MHFPQEQEVSIFDAKFIAESFLRAGLKPMIHGSPGIGKSAVARQIAKENNLKLIDLRLTQMDPADLNGLPNLSGERAKFQVFEQFPLVGDELPVNPETKEPFAGWLLFLDELTSADDDRQAAAYKLILDRQIGNEDLHPKCLVMGAGNLETDGAIVNPMSSALISRLHHIVVRNDLKRWLQVVAPKLDIATKVQAFLEFSPRAFYTFDPQNSGRVYACPRTWEDFSKWFLKMSPEQDPRALDDMLNLAAAMGIIG

SEQ ID NO: 365 - protein, 75 aa, Unknown
  Description of Unknown: Undetermined Phage F770/05 polypeptide
MSKLQDLPVLIDRPGNYVTRDGSRVVIFTVTERPEGYSMLTFDARGSYTRVNNTAKPECWHVSGRLHAFREHRKT

SEQ ID NO: 366 - protein, 255 aa, Unknown
  Description of Unknown: Undetermined Phage F770/05 polypeptide
VSQANEKTIERIGKILLIFKASEGEIRPHFWLTGPSGSGKSFNIMDQCNRLDIMLPMTEVNCASLTKEGYSGLSLSKALAPLATLGNVPNVVFCDEMDKLFLSGNSNDSHANEISIGVQNEFLRVLEGSTTQTFGDYGKYNTVCVERSLFIFAGAFNGQENMDATELLKCGVKTEFIGRTGLVYNLEKPTLEAMVQYLKESELWANYRSLFPKEDHKKAEKWLIKEIGRQYPDSNIGVRLINTLIHQYYINAGED

SEQ ID NO: 367 - protein, 61 aa, Unknown
  Description of Unknown: Undetermined Phage F770/05 polypeptide
MQFSDLSPVEQKLYPTHSSLKEALEEARHLLPGGSHHDFMRAMMGYHNTFLLFVGEWTPSE

SEQ ID NO: 368 - protein, 77 aa, Unknown
  Description of Unknown: Undetermined Phage F770/05 polypeptide
MSGDAIAMIVAYFATAIVAAGLFDFVLYDDYDDKADRSVTLGILWPIALPIVFGLTVTKIIKTAWKGFKDLCKYGIK

SEQ ID NO: 369 - protein, 147 aa, Unknown
  Description of Unknown: Undetermined Phage F770/05 polypeptide
MLSEERIEHELSSLKNVLDGLRRKITVLHNKRSILSEEIDTTERHVQSYVKRLEELDKEFFELRQNQTIVHPDVQGQGQDEQTTAVLKDAVVTQMGNKLAEVLDALGFGKEHVQKHGLDETVYDACLYVQSLKGGEALLNNLRSMLK

SEQ ID NO: 370 - protein, 192 aa, Unknown
  Description of Unknown: Undetermined Phage F770/05 polypeptide
MEKITWFQRGNPIDVPIDRCLYFLADGKLVQFAYHNDLGQLQIAFMTGISVGKLYAALKGKFVYVRHGFIVANQRVGIKVGRSSHNIPIAVYVKGQEHLCVQLTAGAKELVKAQFTGDHVLWSTKIKPGDTLVMLPGEPGERVRKKVVIEEIGTETHYNWCGHACFEIAVIDKHGYRYTELNDHFQLYGVNK

SEQ ID NO: 371 - protein, 137 aa, Unknown
  Description of Unknown: Undetermined Phage F770/05 polypeptide
MSLRQVLAGTEQEVRIVALLEVGVLPHDGMNQGVHGQFSIATALLANLVLEPLDFLHGFGELLLQASIHRLEDCLFRDDLGSSFRLHGERLGEFGDLLVACFDGRLQLADLGLQAIIIALSTRVDPTVVLGFRECCV

SEQ ID NO: 372 - protein, 191 aa, Unknown
  Description of Unknown: Undetermined Phage F770/05 polypeptide
MHTFEPGDPMTVIHDSFEHIDSTEGLEAELRAFGAMWWLRGETSWWSRFRQAEERPEHVMYYDIANFIMENDFLIDNVGKRFKLGDEEEEFLEMLRKLVEEAMERDSQYRNKPVARSVLHQASVLAMDWVRVGYRAARRKYPDNFAVADLMYYLYERVRYISHDAYEGSTLQLKYTLNGKYVQVYLDGELR

SEQ ID NO: 373 - protein, 74 aa, Unknown
  Description of Unknown: Undetermined Phage F770/05 polypeptide
MRKSYLKFLDTMAWIVAVLVFVVVAVASLTVYNGLVALFVMLGAAVGIGMTFGFWFLGYGIYEELQKLNARVRA

SEQ ID NO: 374 - protein, 255 aa, Unknown
  Description of Unknown: Undetermined Phage F770/05 polypeptide
MTPYTAFEYLLIDAANQMGHDKWLFEQRIQWCYDNFDDLENLECNEKTRPQYLKAVMAIRAAQRGEPVGHLVGLDACCSGMQIMSALGGCESGAQATNLINTGFRQDAYSLVTTAASTHLGESVGEIKRSDIKTATMTHFYGSKAEPKNLFGEDTPELEAFYQGVEMVAPIANEMRDDLINTWQPYAMKHSWVLPDNFHSIVKSVDVFETRVEVDEMEGASFEYIYKQDCGVERAVKNAANVIHSIDAYVLRSMH

SEQ ID NO: 375 - protein, 90 aa, Unknown
  Description of Unknown: Undetermined Phage F770/05 polypeptide
MNVAAWLHNGEWHLFTDEMNRVVSDQAYYQAGLKGPDKRDLVLLRMTAKRRNTAYWFHFRKDNPFNKYMPVAYTEEIPKELQALLTIYGL

SEQ ID NO: 376 - protein, 94 aa, Unknown
  Description of Unknown: Undetermined Phage F770/05 polypeptide
MELVVWKDGDNWRVFADDAVPALDGTVDRVAEGLATLYRKEKEPVVFTRRKTAFYDGQYWLMWKYYPTYGRAYGKEASDEMIKEPSAIALLAGY

SEQ ID NO: 377 - protein, 86 aa, Unknown
  Description of Unknown: Undetermined Phage F770/05 polypeptide
VSHYAFYKEDDTWKFVKYGGLLELVQAASMMAYSPKEAAACTCYKLNGVRWWWMGMTDKDAIEDVNLLPADLRAMLVIWSLDQLLE

SEQ ID NO: 378 - protein, 255 aa, Unknown
  Description of Unknown: Undetermined Phage F770/05 polypeptide
MTITHMLPEDMQRANEYRFARAHIDGYIREFIRGDEDLPALMERGIALLEEYRTTEYSYNSKNLRMETVRNLDLEHIVFEIIVASAYCQVPDMFISFTAKLAGVLGFDDKADSIKTIAEMVAVLAELDVYDIEQVYKYGTYKVISNIQLPEKLQHAVERAMYLPPMVCKPSKLTGNKSKLHLTLEKESLILNNNHHNEDICLDVLDKMNAVELCLNTEFLSTVEEESHKYLDTQDKKDDWYRFVSESHEMYKLMV

SEQ ID NO: 379 - protein, 115 aa, Unknown
  Description of Unknown: Undetermined Phage F770/05 polypeptide
MRINAHNKDMFTMVGIREAEQNMARKFNTMLISDSLRKGESCLYIFDGLTEEVFRKDLSNVASGLMMSRLKSYTDPFKKLYTKHNGRWFVFSSDFNPVAEKLVPPEIRAQSLLFD

SEQ ID NO: 380 - protein, 146 aa, Unknown
  Description of Unknown: Undetermined Phage F770/05 polypeptide
MPQFVVGNMWEAFDKADHFIVLSNSTLTSTGAVVMTAGMAAELVARFHDAGIQTSVGQYIAENGGAGGIFGCRCQSKVGVFQDKRHYRDPTDLGCVSTSTTQLMWRAQENPTHQYHLEQPGQNEPWWLIKDILARLPGNVTIWSRP

SEQ ID NO: 381 - protein, 83 aa, Unknown
  Description of Unknown: Undetermined Phage F770/05 polypeptide
MTRTYLKRVVIRDDNGMFVSDGDTLIDALREVKLKNLLKQLTVIDQDDGHRWMFQYSHVNNHIVLTKQSPDCCDGIIRMGDLL

SEQ ID NO: 382 - protein, 133 aa, Unknown
  Description of Unknown: Undetermined Phage F770/05 polypeptide
METNHMIFVFGSNTAGIHGAGAALYARNNKGAEMGVGEGPTGMSYALPTKYRAHGGRLVTCHISDVAKAVQRFMDFAKEHSYMSFQVTRIGCGLAGFHDSDIAPLFQAAPDNCYFSEAWKPWLKPTTKYWGNE

SEQ ID NO: 383 - protein, 97 aa, Unknown
  Description of Unknown: Undetermined Phage F770/05 polypeptide
MPTDLKTPTGGTVTGRLVVDRDYLNKLLEVRKYSDRKIDMVYIDMTALEERVMAHMLDQIPKPVKKSKRRPKWEMPVRNHETNHLGKGPRNKFGGFN

SEQ ID NO: 384 - protein, 96 aa, Unknown
  Description of Unknown: Undetermined Phage F770/05 polypeptide
MALKKSNARTNTAAQSDDTRAASFINISIGTRGGDPVRLGNGIPLRLSEAVEAQLHEYLAEAKDDKDLAKRIENLRSRLILSFRVVRDKSELQLDL

SEQ ID NO: 385 - protein, 61 aa, Unknown
  Description of Unknown: Undetermined Phage F770/05 polypeptide
MIVLITRKATSILDRGYRECLDAESVARELHAIGMSAVTEEDVLNHWADWDNDLSDEPRWV

SEQ ID NO: 386 - protein, 73 aa, Unknown
  Description of Unknown: Undetermined Phage F770/05 polypeptide
VTDVEILNLLCLYIASSVAVLNGYMKWSSNNYTMQQTWMGLVIDILVMHVLTFSGMFALIGAVCIFFNLVGLL

SEQ ID NO: 387 - protein, 77 aa, Unknown
  Description of Unknown: Undetermined Phage F770/05 polypeptide
VIILIMFLLFAVGLSMLVIGLHRQWVINEMLRFPLSISRRHDLEMRRIHAWVMAVCGLGLLFAGCGPLFIFLAGGLL

SEQ ID NO: 388 - protein, 72 aa, Unknown
  Description of Unknown: Undetermined Phage F770/05 polypeptide
MTIVQLLAVIAVLLLVVPTVLSFLRMLVWAAETWVRCETGRGNRGTAAVATVLYGVATWVCAYLFFVVGAYL

SEQ ID NO: 389 - protein, 67 aa, Unknown
  Description of Unknown: Undetermined Phage F770/05 polypeptide
MLTIACIVLIVFCGYLFLVKCLASLTCFGALFVLPGAEKVAAVVGLVWNVFWAAVWVTAINFLFHVA

SEQ ID NO: 390 - protein, 98 aa, Unknown
  Description of Unknown: Undetermined Phage F770/05 polypeptide
MSTNLNLTGRLFDIKIIPTNGKLTGFRVRMTLFNMDCPNTVLTHVVMCGDEYTAKSLKTAILQRRRLNLKHWHWTEVNKDLPGACTNRLKTKPFTLEI

SEQ ID NO: 391 - protein, 102 aa, Unknown
  Description of Unknown: Undetermined Phage F770/05 polypeptide
MRTIAELIKIGLEWQQANRGETYMCFVLSDLANGVVVGPPITWDEYRSFKNWLWEKLHFRGSDSVLGLLERVGLDDSEENWVQFYAWAYYDLIKRNTYEHQP

SEQ ID NO: 392 - protein, 83 aa, Unknown
  Description of Unknown: Undetermined Phage F770/05 polypeptide
MMYKYARIKRVRNITVYDIACQCWARDFQYDQCLFLLIQHGFSPIQSLEEFQRVWNMLDQAFADFCNERGCPADPIGFADVRI

SEQ ID NO: 393 - protein, 80 aa, Unknown
  Description of Unknown: Undetermined Phage F770/05 polypeptide
MNTLYHKMQEHVCFVGFTRDGVNYQTNRVRTFGEARHFITFNCSPSDKDIRIFYRIPHEGAEDVEVVIARLDLTETKENN

SEQ ID NO: 394 - protein, 76 aa, Unknown
  Description of Unknown: Undetermined Phage F770/05 polypeptide
MSNPHSVFRVNKCFVRMVTNGELITSPTIHNLEEMRDYNRNNCKPTDTGIRLSYMSETEGCEVVLARFDHNGKVLV

SEQ ID NO: 395 - protein, 63 aa, Unknown
  Description of Unknown: Undetermined Phage F770/05 polypeptide
MDQNIYTLLYTNECLHSIEHEFEAVSDEVARIKATAMCRGQEGLWSGIYLTDPQGEAITFDPF

SEQ ID NO: 396 - protein, 84 aa, Unknown
  Description of Unknown: Undetermined Phage F770/05 polypeptide
MFKALNQFFAMLESMFRAVTNLTKAAENVTEWAEEESAHFNNKARLQREQAIALLNIENAQELQEKGLTEAVESVRKERTKAKA

SEQ ID NO: 397 - protein, 35 aa, Unknown
  Description of Unknown: Undetermined Phage F770/05 polypeptide
MVVVTQDQSTAQPKASLDLEVQTDDWVEVELNKVG

SEQ ID NO: 398 - protein, 216 aa, Unknown
  Description of Unknown: Undetermined Phage F770/05 polypeptide
MNNKAVLNIKLPGQELVEIDLGISWHEYINNAGDDNTGLVYVKLAEYAELFDVVPNNPAEKKIAELEAKVKELEDKLKATSTEENRESFLCRVASRGSRKQADIVKKDGLFYWVGTIRGTTLRMESTFMDADFDPVLRDARDWVKTPTVMSGGLGVLVMSDRARNHRLELYWFAATGLFTGVATHTETGLAYVSPVKHRDWKDAWREIGCYIQGKD

SEQ ID NO: 399 - protein, 102 aa, Unknown
  Description of Unknown: Undetermined Phage F770/05 polypeptide
MELNDTGKIRIVLTIQGKAYYLDALLTRDEWDTMTDAQKTKYMNEWVLASVSIRPQMPSSESDILKHKIHELELEVSRLKKQATPTFRYPPGVTIGHLPDQR

SEQ ID NO: 400 - protein, 86 aa, Unknown
  Description of Unknown: Undetermined Phage F770/05 polypeptide
MKADWVSNLIFALVWSLYVPKPASEEHLWLFHLLHFLFALLLWTAIDVTRYSPEWKEKPVFAFFIFAPMVPMNLYGAMMLLELLWN

SEQ ID NO: 401 - protein, 70 aa, Unknown
  Description of Unknown: Undetermined Phage F770/05 polypeptide
MDISYAHVQMKLKNGKTTSHKVEIPYSLSEVQDDFYSTVAQILNLVRRGTGISVLNVTHSRVLFTAGPNQ

SEQ ID NO: 402 - protein, 143 aa, Unknown
  Description of Unknown: Undetermined Phage F770/05 polypeptide
MQLEPYARHIVNGELMSRNARVECGTKVFLLRDTLTHNPDTGRKLALGAGSQVIVMGLCIQYTEKGNIPLIAVHSINEDGDLFHALVDPNHLCYAECPVDRVLKLVQVEEMTVMLRNKGYEQSEKVAELLYSYGIHQLQEGKL

SEQ ID NO: 403 - protein, 129 aa, Unknown
  Description of Unknown: Undetermined Phage F770/05 polypeptide
MVDRLLLDVSIEHMAWDQCLFQDEVHQLRLVVAGDVAGHVLVGHTLLGPPLDLGGEGTGVSLGVVQPHQLIGHVLRSMEVVVQLELTFLHHMGVPNDVVPEGFRHVRIGQHVIECLQYFRGDGLLHLVR

SEQ ID NO: 404 - protein, 85 aa, Unknown
  Description of Unknown: Undetermined Phage F770/05 polypeptide
MQNAQSEKVQQESANSLLTHLKSPEKTELKIDVSDRAADAIDIMRQNAEALARLQQEMIAGKQLSAKDVAERSMDFGEVIEGELA

SEQ ID NO: 405 - protein, 255 aa, Unknown
  Description of Unknown: Undetermined Phage F770/05 polypeptide
MNLDATPIAKAVADEVDFAGLDEAAKSVEQWLREVVYGDDSSYIPSIFALQFVDFIKMVNGNEGEENKTPVLHLRMLDQIGSGQTRIANMVFRGAAKTTVMGEYLFLYIALYGELPGFGKVDLALYVSDSIDNGVKNMRKNLEFRWENSEFLKKYIPQTNFTDIRWKFTNLDGKVFIVKGYGAKTGVRGAKEMGKRPQLAVLDDLVSDEDARSPTVIAAIEDTVYKAVDYALHPKKNMIIWSGTPFNAKDPLYKA

SEQ ID NO: 406 - protein, 244 aa, Unknown
  Description of Unknown: Undetermined Phage F770/05 polypeptide
MTIQLKQVIDLLAEGELSNIKYVNIDTGALVLERVPSLIRAINLGVLDLHKRFLLKEGMLKIQLEEGRRLYPLRPAYQVGQKPKPGVPQFITDGNKLGRQSILKIEKIIGDNGVEYYLNDTWQPLNITTPEFDVLEISEEFYCHSSSKTLEVRYRRAPTPMKICVDNLDSWGCIDIDLPYTHLQALLYFVASRCQTPIGFMENTAQDGFNFSQKYEAECANLDAQNLRIDPVGNQDRFTRGGWV

SEQ ID NO: 407 - protein, 99 aa, Unknown
  Description of Unknown: Undetermined Phage F770/05 polypeptide
MQLIKEYEHAQPLKFKGWQVSEDHEQNVQALQEMLGSFPFITAAFGDNADGERVYSLSNFNEGATLDVKAGEWIFVNEEGSIEGWSAEVGAVRFKEIQA

SEQ ID NO: 408 - protein, 128 aa, Unknown
  Description of Unknown: Undetermined Phage F770/05 polypeptide
MPVRASDTAGGYDIFMPEGGVAYPNQPTKVKLGFSAAVPEGHVALLLPRSGTGSKAGLRLRNTCGVIDSDYRGEWVAVVSTDREPFHWEAGNRVLQMLLVPVATPELQLVEELSETNRGDGGFGSTGE

SEQ ID NO: 409 - protein, 255 aa, Unknown
  Description of Unknown: Undetermined Phage F770/05 polypeptide
MADVDEDYLTLPNEDGDPSKRLQPEWSNAPSLAQLKQDYQEAKQVTDEKITQINRWLDYMHVRGEGKPKTEKGKSAVQPPTIRKQAEWRYSSLSEPFLSSPNIFEVNPVTWEDAESARQNGLVLNQQFNTKLNKQRFIDEYVRAGVDEGTIIVKVGWNYQSRTVKEQVVTYEMMPDSSEELAQIYQTAAQIREESPSEYPEIPEDVRLGLEETEANGIQVRAVPVGSEEEEREETVENHPTAQVCDYNNIVIDPS

SEQ ID NO: 410 - protein, 112 aa, Unknown
  Description of Unknown: Undetermined Phage F770/05 polypeptide
MNEEHAIQITRKNAEKFVRLRDAMLRLHKNRDFQALILNDFLKDNAARLVLLKADKNMESPEMQARIIREIDAVGALHTYFQLIGVRGDEAEQAIKDCDAELERVREEEDEE

SEQ ID NO: 411 - protein, 255 aa, Unknown
  Description of Unknown: Undetermined Phage F770/05 polypeptide
MADFLEMSDDDLPEFYEVEEQTRSDQEEPEQEQQNDEQSEEVVQEEEPADEEQEEEQEEEQDPLNSPDDELGDLPVEEKPTEEESEQEEEEEDGDKEESEETPTEEKPEAKKSEATKQEVDPADFMAKITAPFKANGRDLQVKTPEEAIRLMQMGANYNHKMSALKPNLHMMRQLDDAGLLNPDTIANVVDLLKHKKPEAIAKLAKDAGVDPLDLDEKSVADYKPTAVPFNQVREALDEQLDSIEHSPSYNRVVT

SEQ ID NO: 412 - protein, 255 aa, Unknown
  Description of Unknown: Undetermined Phage F770/05 polypeptide
MAGPVDNIKPMKYNDPANGVESSIGPQIHTRYWYKRALIDAAKEAYFGQLADTFSMPKHYGKEIVRLHYIPLLDDRNVNDQGIDASGATIANGNLYGSSRDVGNITAKMPTLTEIGGRVNRVGFKRVEIKGKLEKYGFFREYTQEQLDFDSDPAMEGHVTTEMVKGANEITEDLLQIDLLNSAGTVRYPGAATSDAEVDASTEVTYDSLMRLRLDLDNARAPTKIKMITGTRMIDTRTVGNARALYVGSDLVPTI

SEQ ID NO: 413 - protein, 221 aa, Unknown
  Description of Unknown: Undetermined Phage F770/05 polypeptide
MSLDELQNLSEAPLESPDTRSELEVLQEKATALGISFRSNTGVEKLREKINAVLNDEAVGDEEEDEATEATSSIPKPSAEAGAAALKAAEAPRPKTEGELRRDRRLAAHRLIRCRITCHNPNKNDWDAEYFSIGNDEIGTIRRLVPYEVDWHVPEALLNFIKSKQYQHFYTVTEQTPMGPQKVRRSKSVREFSVEILPQLSEDELESLRKQQAVNGSYKED

SEQ ID NO: 414 - protein, 255 aa, Unknown
  Description of Unknown: Undetermined Phage F770/05 polypeptide
MAVEPITIADLTEVKLDGKGALDQLLQVTRLHLAKEHDAGRLKGQEYAAVLTGGITAVLQNAVMFLLQKDEAANKAALVEAQIKLTEKQGELLDKQIAQADKDAELIAAKVKLTLEQAKLPDSQIRSAGFQDLLVQEQTKVQTAQTRRIDQEILSAGFQDLLVKEQTAKTKQDVLTAVQQTKVMEQQVLESTQKVLNMKQELLNLVAQECLLKAQFDLTKDQGLNTQEQTILVRQKVASERAQTIGAGVDADSVI

SEQ ID NO: 415 - protein, 255 aa, Unknown
  Description of Unknown: Undetermined Phage F770/05 polypeptide
MGLFSSKKKTVVNTTVQRVFDDAHIPDSPRTGVIQGITHETGIVENILEKLSDSIGVRANTAYLWAQRNNYYWGLPESKVVNGVDARTVVVQTIARSEGTITTYYNQFGPLNSLHWGFTELVRLYQYNPLTNELPGLSTTKGSKVYLFDMIPVFQTDTVAWADETANKGMLQDFGFSPKSGYTPSRPYNTIGGMGQFAGWSPYRTDNSFGEDYVLLTYEWKDAQGVIKQETIRMIMNLDLSLDYHQVRFRRQNGT

SEQ ID NO: 416 - protein, 155 aa, Unknown
  Description of Unknown: Undetermined Phage F770/05 polypeptide
MAYPYSDMPFGVELDTSTLGSFGLGGPQTQLQMQMPAVDVNAAASGSGGFMSGFSNIFSRDSMFGGVAPSGAQTGGWVMPALGIGQAVFGAIGANRQQRAARDQLAESRRQFDMNYGAQRQSINTNLEDRQRARVASNPTAYESVDSYMERNRIR

SEQ ID NO: 417 - protein, 255 aa, Unknown
  Description of Unknown: Undetermined Phage F770/05 polypeptide
MAQEITWRNIGATVSPGSASSMSAGTTGVQQALGALGDIISRQQEMNVNNAKLQREANTQSYLDQVAASTLEQLSNADYRSGLEAQRDAMGMNLDRAATRDAITKQISAQQNQAAATQKFDDMQAEVGQRGIVDQLRTLAAEGRAGEVNQILAEQQLINEGEIRKELTGVQDAIQNRQYRAAGEQRAQAAANRAAEAHSLSMAAGRENLAFTREQRDELRRDRDEAKLVSGTIATTFQDYDESRQAQSEIMRIVG

SEQ ID NO: 418 - protein, 255 aa, Unknown
  Description of Unknown: Undetermined Phage F770/05 polypeptide
MADFDLDQFLSDRQEANAGATPAFDALDFASAGLDMKGSQKAYDLDGIRERKKRNVEESLIGKMGITPGAAGTEILNTAASFVSGTGRALGDVIALPINAAADMGQAGVTNEAIEAYNRYVSAQMQEGDEAILSQTAAGDDGVPQTMLQRMQGVDELRKFSTNVDKFFDWSSIVDTTRRDQLSDDIADATAGGVERLRNAGESFSRGEILDGLVQGALGVGQTAATAIGASATNPLAVGEYTVENAPQILAYAAN

SEQ ID NO: 419 - protein, 67 aa, Unknown
  Description of Unknown: Undetermined Phage F770/05 polypeptide
MGVLKGLFGAGALAGAVIGILFIGFVFSWIFRILGVVVALFIVLLILCWVGWEWLKYCFSRKKEGEQ

SEQ ID NO: 420 - protein, 105 aa, Unknown
  Description of Unknown: Undetermined Phage F770/05 polypeptide
MSLVDAVVEAKRQGVQHSLRGSNYESDIPPSLKALLDEALRLANEHSIPLYWSASLPNGVMTRAALGEKGENIHIQYLMSYAAAVQDPALAQEVVQKGMAFLDKK

SEQ ID NO: 421 - protein, 78 aa, Unknown
  Description of Unknown: Undetermined Phage F770/05 polypeptide
MGDLSKACMLKNMHVTRVLHLIEMRNKLTNTLRDNATDDGMATLEMFDAALKQETDRFLRALRAVGNENINEIKKAAE

SEQ ID NO: 422 - protein, 85 aa, Unknown
  Description of Unknown: Undetermined Phage F770/05 polypeptide
MAKFLLVGCKGWSALVWTPLRGGGCTRCNGPEHSLMPTGSIDIRKPAGGSWLGLQRHQLREVVNGPLDLGGQGGLGSGIQGPMRW

SEQ ID NO: 423 - protein, 51 aa, Unknown
  Description of Unknown: Undetermined Phage F770/05 polypeptide
MAVNTKKSPPTRNHYENFRKGMKVVTYQRTKGNTLFTVDCDPVEVADLHAC

SEQ ID NO: 424 - protein, 134 aa, Unknown
  Description of Unknown: Undetermined Phage F770/05 polypeptide
MKAKSYYLLAFAAPTGVGTVFQSAIHAFEQGKSHDFTVPLIAQIKERSGIGANSIMLSVSFLGTMTEAEFNPPFRPGMDATVAYLEGVRAGLENSEKDNPYPTGSVEAADYRNGRISGFSMREGQQPPQDHSPQ

SEQ ID NO: 425 - protein, 145 aa, Unknown
  Description of Unknown: Undetermined Phage F770/05 polypeptide
MKIELQQAEVAAGIATYLTANGLKADASQLSISFQTTRKGDGGIVAFVEVPELAVASLVGTKAPVATEPQTVEVVEKPKKAEKKVVNTEAAAGLATAVAESKASEAAPVEVATEEPEPATEMEAKEEEPVAEQAAPASTGGSLFS

SEQ ID NO: 426 - protein, 186 aa, Unknown
  Description of Unknown: Undetermined Phage F770/05 polypeptide
MARLNVIGMDPSMSNWGLACGQYDTTSNTLSLRHIEVIQTSKTKDKQIRVNSDDLNRSTEITTRVMEVIKEANVIFVEVPVGSQSAAAMKSYGMCIGILSAVRASGKPFHLLTPTDLKVMACNSKTASKEAMIEWAVKKYPHLNWPRTSKGEVIASRAEHMADACAAAEYGVFHHNDFKLALAMLT

SEQ ID NO: 427 - protein, 147 aa, Unknown
  Description of Unknown: Undetermined Phage F770/05 polypeptide
MKVNPQDVKNMIVEESFTILPSGLTTVCQLTLVNGWTVTGQSSCVDPIEFDAEIGKEVARRNAEDEVWKFAGYELMQKLHKQNMGPKERLKLELDELKARQESLYSFLRSDAAASVHAYMGSLLVQQKDVQNNLIEILEERLQQWQD

SEQ ID NO: 428 - protein, 121 aa, Unknown
  Description of Unknown: Undetermined Phage F770/05 polypeptide
MKVRELLDSLKRQLSYCTNPQQRERLLDHTLRIPVLRPGTVGARPSVDVLSVVPGFDWDDGSMFCEPNSDIKLTVLTPEEVKTIMASYSKGTSWFAYQETKKLREEINRLKKQLELLGGSE

SEQ ID NO: 429 - protein, 248 aa, Unknown
  Description of Unknown: Undetermined Phage F770/05 polypeptide
MFGNLSTSNNSDIKEAKDSIGGGSRIFDTDIYAFKILAAYGSESSGGALAVNFEFEEHGTGRKLKIQQYVTSSKEKGQNNYYVNAEGEKHYLPGFNIVNAICLMTAEKELAACVPEQRTLKIYDYDAKAEVPKQVPVLADLTGKDIYLALEKIIENKRVKNEATGQYEDSSETRELNDVAAVFHFGTKKTLNEARAKAEPEFFDKWKEAKAGTVRDKTKKVAGGGAASGRPAPAGGQAGGGKPASLFS

SEQ ID NO: 430 - protein, 244 aa, Unknown
  Description of Unknown: Undetermined Phage F770/05 polypeptide
MTQVNDHLVLVSGLSATGKSACLRNLREPEKVIYLNCEAGKRLPFKSRFIERTVTDPYQIPTVFDAVVEGKVEAHTIIIDTLTYLLDMYESQYIYRAANGQAAWMDFQQFFKDLMQQKVASSPCKVIFLAHTKEEYNKATMAMDVCVPVKGALKNNGIESYFSTVISTKKVELGKLEPFKENNKLLEITPQEEMLGYKHVFQTQITKETVGERIRGPMGMWTHEQTFIDNDIQKVLDHLDWYYN

SEQ ID NO: 431 - protein, 255 aa, Unknown
  Description of Unknown: Undetermined Phage F770/05 polypeptide
MLKYEEMQHHPTSERIVEILCEKTQSKNHRFFRILVGFQFSMMAAHMRCHIKTHERGEIPVNMYALNLMPSGAGKGFSTKVMEDQITYGFRHRFMETFDTAAEKHLDDLAFKRHIRKGSELPDEQEAVRKEFKSLGPLLYDFDSGTGPAVKQMRHKLLMANAGAVNLVVDEIGLNLPAMTEIMPTFLELFDVGSVKQKLVKNTNDNLRGEEIIGRTPTNLMAFGTPGKLLDGGKTEDQLMELLETGYARRCFFGM

SEQ ID NO: 432 - protein, 255 aa, Unknown
  Description of Unknown: Undetermined Phage F770/05 polypeptide
MGQIYTNQTGIPMAMALWLASDYYDYSEAGLSATTLLKPIRQVVLARRIKPSDSMADIEGMIANRMGAAIHDSIEKAWTVNKDRALDALGIPASVAKRVLVNPTEAELKAFNEANEQPAITVYMEQRSKKEYAGVMVSGKYDFVADGQVEDFKSTTTFSYIKDSKDSDYILQGSIYRALNPGLITKDTMRIHFIFTDWQKFMAKQNKDYPQSRVASKVFNLMPIAETEEWITNRVKWLMSLKDTPEADLPLCSDE

SEQ ID NO: 433 - protein, 126 aa, Unknown
  Description of Unknown: Undetermined Phage F770/05 polypeptide
MRDPRYSPHPVCKAQHPQGQPCEDCEKLHRRLPVKSAEPAHKVQRDTAPLNRYQRPIPRAWKFVDVYRINMLFPLGELDPSGALDHARKKLMAPGQRSGGKSLWQDVKEARDTLNRWLEDNAGEDD

SEQ ID NO: 434 - protein, 142 aa, Unknown
  Description of Unknown: Undetermined Phage F770/05 polypeptide
MEKLTPEDVPFKDFPIDSMPNLLAQMGKARADTIRFHGLDRRSIGGPRTRWFTNPHAKRLQGLPDAFSDRGVEDILSGIASATEGSQRPLSAARLFVLLQEPQLCYDLLMGGMALEKRQALRYMAAAKLAVFHLNRYFGASQ

SEQ ID NO: 435 - protein, 255 aa, Unknown
  Description of Unknown: Undetermined Phage F770/05 polypeptide
MVDTCNINGVCGTGDWNGPKPGDPNMNDLLLKATPAFGGIDIEFTWPTTNPGAVGTTRLFRSTDANFAGATIRAFVNGNFYFDKTDPGSKVDQRYYYWIQLVSINGTDGDIIGPASATARPLIEQMIEQLTGEIDSGLLSQELRKEIAQIELNKLGITQEEIERAKNDDALGVRLTQIDAKMDQNTAILQEEVRARVTADSSLVQTVNTMYADFNGNIAAIQQENTALATKVNALASSVTTINATVNGDSASGKV

SEQ ID NO: 436 - protein, 99 aa, Unknown
  Description of Unknown: Undetermined Phage F770/05 polypeptide
MSYGFRFYDANGNVTVDSTNKSFRSVYRQQVFPVLGGTTNLPPGFDASKGDIFFFTWFQLAPNPWPQFVDFGFVNNQIQWYDTYSTSYGKAYLNVVSFR

SEQ ID NO: 437 - protein, 223 aa, Unknown
  Description of Unknown: Undetermined Phage F770/05 polypeptide
MTYGIKLTNENSDICIDELNPVYVVVFEGSYKYDSPGQDFIYVQFPTPIRSQSLPIFFAKQDGPHGFMDFTWFGSNGNWTGCRFVLTNFAGMAPSVYSGKYKIVAVHMPKTAGWGMQVFDADGNGVFDTGYTPAVFLGGIQRFLPYGYNPNFPGGRTLGSWYADATKIKQGAYFRVDFGNTTFRHNGFTIGMLNGPTGWMYIAAFISGNKPGYTIDHPLLAIE

SEQ ID NO: 438 - protein, 1024 aa, Unknown
  Description of Unknown: Undetermined Phage F770/05 polypeptide
MTTKVIFTFHNPDGSPQANEKFTVRLTRPGMSDAEHCVVIPETYEMVTDAKGEFTMDLESSTSAYRVTAIGDDDEYEDDPCSQYTFTFYVPDSVDPVYVQELILMPPPNNLPWDEEAMNKITQAVVDARNARDDAEESADRAEAQVGLAAEQVTLAKAEVTKATAQADRSKTEADRATTQATNAANSATAAANSATQANTQANRAKTEADRSKSEADRARDLADAVAEKVEGGSLPPLVGMNETFTYEGTDPYRWTVSGPATAVSDGSVMRLTKTDGSGSRAFVRQAVSFPDSHWIVYMRVKTQTGTASRNCSAQIRFIAADNKNCVVYFNVNANGLVEPNTIHMQGTEGDTRNAATMFTGLGTEDWLDLAVKYDAVNRHIELFRRMPNGTWQKGGGRLMVDAIKPAFIEISSMPVAPQNWWLDTDFISVCKPNLICYGDSIAAGQNEYGVTRGNNPYNNNRNWAGTWFGKVPLYATNRNNLVLVQGVEGRRTWQYLSQLSEISNSGVKVVFIHASTNDVNDATMTMAKRTSDTQAIIDQLHAVGAQVVLFNSMQGTKAYNDASSTTVKLRDYTDQWWNTELPKVNGLAQTLDIARLIAKDGYMDPALGASDGLHLTNASAQKIADKLGQFFSNSSDTNGFASLDSPAFTGIPTVPTQTPFLPYGKQIANTEYVSTFIQDWTSNYGYGDLTMRNLTGAQMAGGGVRSGYYYVPGDSSNPLPGNVYAFVHHMSYDTNKGWELWNHCYTDRVYMRYSNNAGVWNTPVEMVTEKWMERNSFMTPRVSAFNRLPVASSVGFEGVVPLQTNSSGAWRNVNAGVAGLGLLGATTAGNALNYIGGMPKAPTNDRANSNLNNLPDECGFYGLGPAPYSNIPPGVDAINPVGSTVYHQVYDANTATQIFIPRTSDICYFRRKAGGTWSPWVRYLTDLQLVGTTTDSSAGVPNGAIMQVNGSAAVNVGVALRFADGTQIVRALLQLDYGAVDILQRQFTFPMAFVGKPVVTATLEQGTVADINNMPLQALGPVM

SEQ ID NO: 439 - protein, 124 aa, Unknown
  Description of Unknown: Undetermined Phage F197/08 polypeptide
NYPRDVSTNGTVEYLVVTSDYKRMTYRPNGTNKVFVKRKEAGSWSEWSELAINDYNTPFETVQSAQSKANMAESNAKLYADDKFNKRYSVIFDGTANGVGSTLYLNESLDQFILLIFLWDFSRW

SEQ ID NO: 440 - protein, 62 aa, Unknown
  Description of Unknown: Undetermined Phage F197/08 polypeptide
LNPSNLPDGDGNGGGVYEFGLTKSSRTSLTISNDVYFDLGSQRGSGANANRGTINKIIGVRK

SEQ ID NO: 441 - protein, 122 aa, Unknown
  Description of Unknown: Undetermined Phage F197/08 polypeptide
MQILVNKRNEIISYAIIGGFEEGIDIENLPENFSQVFRPKAFKYSNGEIVFNEDYSEEKDDLHQQIDSEEQNTVASDDILRKMVASMQKQVVQSTKLSMQVNKQNALMAKQLVTLNKKIRRG

SEQ ID NO: 442 - protein, 54 aa, Unknown
  Description of Unknown: Undetermined Phage F197/08 polypeptide
MLKLISPTFEDIKTWYQLKEYSKEDIAWYVDMEVIDKEEYAIITGEKYPENLES

SEQ ID NO: 443 - protein, 42 aa, Unknown
  Description of Unknown: Undetermined Phage F197/08 polypeptide
MFGFTKRHEQDWRLTRLEENDKTMFEKFDRIEDSLRTQEKNL

SEQ ID NO: 444 - protein, 69 aa, Unknown
  Description of Unknown: Undetermined Phage F197/08 polypeptide
MDAKVITRYIVLILALVNQFLANKGISPIPVDEESVSSIILTVVALYTTYKDNPTSQEGKWANQKIKEI

SEQ ID NO: 445 - protein, 31 aa, Unknown
  Description of Unknown: Undetermined Phage F197/08 polypeptide
KAESKYRKATGQAPIKEVMTPTNMNDTNDLG

SEQ ID NO: 446 - protein, 192 aa, Unknown
  Description of Unknown: Undetermined Phage F197/08 polypeptide
MTNVDNKKTKQKKWFDNSLGKQFNPDLFYGFQCYDYANMFFMIATGERLQGLYAYNIPFDNKARIEKYGQIIKNYDSFLPQKLDIVVFPSKYGGGAGHVEIVESANLNTFTSYGQNWNGKGWTNGVAQPGWGPETVTRHVHYYDDPMYFIRLNFPDKVSVGDKAKSVIKQATAKKQAVIKPKKNYACSRSWL

SEQ ID NO: 447 - protein, 213 aa, Unknown
  Description of Unknown: Undetermined Phage F197/08 polypeptide
MLVAGHGYNDPGAVGNGTNERDFIRKYITPNIAKYLRHAGHEVALYGGSSQSQDMYQDTAYGVNVGNKKDYGLYWVKSQGYDIVLEIHLDAAGESASGGHVIISSQFNADTIDKSIQDVIKNNLGQIRGVTPRNDLLNVNVSAEINMNYRLSELGFITNKKDMDWIKKNYDLYSKLIAGAIHGKPIGGLVAGNVKTSAKNQKKSTSASRLYTR

SEQ ID NO: 448 - protein, 111 aa, Unknown
  Description of Unknown: Undetermined Phage F197/08 polypeptide
MLKHQLKTKKNPPVPAGYTPDKNNVPYKKETGYYTVANVKGNNVRDGYSTNSRITGVLPNNTTITYDGAYCINGYRWITYIANSGQRRYIATGEVDKAGNRISSFGKFSTI

SEQ ID NO: 449 - protein, 103 aa, Unknown
  Description of Unknown: Undetermined Phage F197/08 polypeptide
MLYLLLYSRSELYSRAEAMYLTVGPTGDIFLVITRYIYLNNIEMLHSLQPYLNRYGYIYSPTTNKTTDPINLGLWLFFCVFFGAKKRADYLKKGQTLVENLKG

SEQ ID NO: 450 - protein, 81 aa, Unknown
  Description of Unknown: Undetermined Phage F197/08 polypeptide
MLTEGSYSQQKKGNPLCNNQIAGVLKKTTKALNMNKKVTTHTFRHTHITLLVEMNVSLKAIMKRVGHVDEKNNHSHIYSCN

SEQ ID NO: 451 - protein, 252 aa, Unknown
  Description of Unknown: Undetermined Phage F197/08 polypeptide
LTFHALLDEWLEYHIKTSGSKLTTLNNIKIRIRNIKRYSSENLLLNKLDTKYMQIFINKLSDIYSQNQVTRQLGDMKGAIKYAVKFYNYPNEYLLTNVKIPKRRKTIEDIEKDESKMYNYLEMNQVLQIRDHILNDNKLHKRNRILIASILEVQALTGMRIGELQALQEKDIDLLNKTINITGTIHRIKYEEGFGYKDTTKTISSKRSISINSRTVEIFKKIILENKMLKRWNSSYVDRGFIFTTKKRESFM

SEQ ID NO: 452 - protein, 59 aa, Unknown
  Description of Unknown: Undetermined Phage F197/08 polypeptide
MWIEKFKNKNNETKYRYYEKYKDPYTDKWKRVSVVLNKNTKQSQKRSNVSFRRKNKRKN

SEQ ID NO: 453 - protein, 49 aa, Unknown
  Description of Unknown: Undetermined Phage F197/08 polypeptide
MTQFLGALLLTGVLGYIPYKYLTMIGLVSEKKQGYQYSCIIDFFLLKHV

SEQ ID NO: 454 - protein, 139 aa, Unknown
  Description of Unknown: Undetermined Phage F197/08 polypeptide
LNLIQLLTGLKANILFLFIFVLTVFVFNPLIVKFIIWLINITRKFMKLDCISLLDKRDKLFNNNGKPVFIVIKDFENRIIEEGELKTYNSAGSDFDLLEVERQDFKVSDLASNDELYIKHTLVDLKQQIKLDLYLMNEY

SEQ ID NO: 455 - protein, 53 aa, Unknown
  Description of Unknown: Undetermined Phage F197/08 polypeptide
LNGGENFMVDKNKKQETTRSNPLNKSFEKSGASEKLKSTLSEKAKKKRLVFIH

SEQ ID NO: 456 - protein, 131 aa, Unknown
  Description of Unknown: Undetermined Phage F197/08 polypeptide
METNKTIDLMNYVEFPKRYTEAKGKLVAQPITTINSARRVENEDMTVCYILDQDDDVMDFIFDRDIITVYCPENGTATDEYFCEIIFNSDDTFTLKRLSNYVTIKDRSYPMSKINDVNITGKVVRLFRDFK

SEQ ID NO: 457 - protein, 128 aa, Unknown
  Description of Unknown: Undetermined Phage F197/08 polypeptide
VKKEKTKKKKKIKKSQTQKHKDSKPKTQQEKNEKKLKIKNPPNNSIQNNSNNQNQSQNNQLNNNSDPSNNTPANINENDSQNTNLNDEYVVSPGWTKDEQAKAFEEYKKGKEEEARAGASAVPGANIN

SEQ ID NO: 458 - protein, 153 aa, Unknown
  Description of Unknown: Undetermined Phage F197/08 polypeptide
LGLYEELCINNEKIKIEETDQLPNFQPGCYMNGKIYIRRNLSEVRKAEVLYEELAHHKLTYGNILDQTKWINRKFENYARRHGFTSAVPLHEIVEAHNYGVRNLYELSEYLQLSESYILEAIEQYKKIYGIGTHYGEYSITFEPLRVFKYKEI

SEQ ID NO: 459 - protein, 109 aa, Unknown
  Description of Unknown: Undetermined Phage F197/08 polypeptide
MENNKVRKILSENLQELMNDKNIDQRELAEAIGVSQPTVSNWIQQTKYPRIKRIQQLADYFNVPKSRITESKKDIHQETIAAHFDKEGLTEEEIEEVNRFIEWVRNRDK

SEQ ID NO: 460 - protein, 63 aa, Unknown
  Description of Unknown: Undetermined Phage F197/08 polypeptide
MPEQLSVRKWRLVRDLKQQEVADILGVNAKTVGHWEKDDTNLSNVTVYALAKLYDIEVDQIKV

SEQ ID NO: 461 - protein, 58 aa, Unknown
  Description of Unknown: Undetermined Phage F197/08 polypeptide
MNEEKLKMILLLLEDIPRDEWNRLVNEVNNQYSYQADKVGLASDNCQQIANNYKHYGF

SEQ ID NO: 462 - protein, 79 aa, Unknown
  Description of Unknown: Undetermined Phage F197/08 polypeptide
VISIHKRLLTQYLDKEIVTSLDLHLINGEVIKVQEHIKDAESKTLHIIHPKDRVVSLDHVLYFDINVKGEKNNDSPYPS

SEQ ID NO: 463 - protein, 71 aa, Unknown
  Description of Unknown: Undetermined Phage F197/08 polypeptide
VKKLYATPTQIHQLFGVCRSTVYNWLKYYRKDNLGVENLYIDYSPTGTLINISKLEEYLIRKHKKMVLGGY

SEQ ID NO: 464 - protein, 53 aa, Unknown
  Description of Unknown: Undetermined Phage F197/08 polypeptide
MSDTYKSYLIAVLCFTVLAIVLMPLLYFTTAWSIAGFASIATFIYYKEYFYEE

SEQ ID NO: 465 - protein, 84 aa, Unknown
  Description of Unknown: Undetermined Phage F197/08 polypeptide
MAENIKTEQHYYTKDFSGYRNEEDNFVANQELTVTITLNEYRKLIEIKAVKDKEEDTYRGKYFEEERKKRKIGKRKYKTKKQNL

SEQ ID NO: 466 - protein, 86 aa, Unknown
  Description of Unknown: Undetermined Phage F197/08 polypeptide
MYYKIGEIKNKIISFNGFEFKVSAMKRHDGISIQIKDMNNVPFKSFHVIDLSELYIAMDAIHDVVNEWIEENTDEQDKLMNLVMKW

SEQ ID NO: 467 - protein, 82 aa, Unknown
  Description of Unknown: Undetermined Phage F197/08 polypeptide
MAILEDIFEELKLLNNNLRVLNTELSTVDSSIVQEKVKEAPMPKEETAQLESIEEVKETSADLTKDYVLSVGKEFLKKSRYF

SEQ ID NO: 468 - protein, 278 aa, Unknown
  Description of Unknown: Undetermined Phage F197/08 polypeptide
MKLDHSNRAHAKLSASGAKQWLNCPPSIKASEGIADKSTVFAEEGTFAHELSELYFSLKYEGLTQFEFNKAFQNYKRNQYYSEELREYVEEYVANVEEKYNEALSRDNDVIALFETKLDLGKYVPESFGTGDVIIFSGGVLEIIDLKYGKGIEVSAIDNPQLRLYGLGAYELLSLMYDIHTIRMTIIQPRIDNFSTEELPISRLLQWGADFVKPLARLAYNGGGEFKAGSHCRFCKINHSCRTRAEYMQNVPQKPPHLLSDEEIAELLYKLPDIKKMG

SEQ ID NO: 469 - protein, 91 aa, Unknown
  Description of Unknown: Undetermined Phage F197/08 polypeptide
MKRLQNFYINCLISKKWADEVEQYALNQAKENDKNYPGWKLVEGRSRRMITDTKAMLEKLVEAGYKPEDITETKLLSITNLEKLIGKKSIF

SEQ ID NO: 470 - protein, 44 aa, Unknown
  Description of Unknown: Undetermined Phage F197/08 polypeptide
LVKKAFSKITEGFIEKPQGKLTLATESDKRPAIKQSAEDDFDKL

SEQ ID NO: 471 - protein, 39 aa, Unknown
  Description of Unknown: Undetermined Phage F197/08 polypeptide
MILTNYKNLKGRYINMKAKVLNKTKVITGKVRASYAHIF

SEQ ID NO: 472 - protein, 153 aa, Unknown
  Description of Unknown: Undetermined Phage F197/08 polypeptide
MHIFFEPHSMQEGQESKYSISLIIPKSDTSTIKAIEQAIEAAKEEGKVSKFGGKVPANLKLPLRDGDTEREDDVNYQDAYFINASSKQAPGIIDQNKIRLTDSGTVVSGDYIRASINLFPFNTNGNKGIAVGLNNIQLVEKRRTSWRCKCSRR

SEQ ID NO: 473 - protein, 77 aa, Unknown
  Description of Unknown: Undetermined Phage F197/08 polypeptide
MNIDIETYSSNDISKCGAYKYTEAEDFEILIIAYSIDGGAISAIDMTKVDNEPFHADFETFKIALFDPAVKKVCIQC

SEQ ID NO: 474 - protein, 90 aa, Unknown
  Description of Unknown: Undetermined Phage F197/08 polypeptide
MPPEEWICTMVNSMRIGLPASLDKVGEVLRLQNQKDKAGKNLIRYFSIPCKPTKVNGGRTRNLPEHDLEKMATIYRLLYSRCRSRNDDCS

SEQ ID NO: 475 - protein, 138 aa, Unknown
  Description of Unknown: Undetermined Phage F197/08 polypeptide
MEEEQETCLNMILKKWQQFIDYCIRDVEVEMTIAHKIKDFPVTAIEQAYWVFDQHINDRGIKLSKSLMLGANVLDKQSKEELLNQAKHITGLENPNSPTQLLAWLKDDQGLDIPNLQKKTVQEYLKEATGKAKKNARN

SEQ ID NO: 476 - protein, 121 aa, Unknown
  Description of Unknown: Undetermined Phage F197/08 polypeptide
MHDMMCSDERVRGLFQFYGAGTGRWAGRGVQLQNLTKHYISDTELEIARDLIKEQRFDDLDLLLNVHPQDLLSQLVRTTFTAEEGNELAVSDFFCNRGKSHSMVCKRTMAFRCVQHTRKDI

SEQ ID NO: 477 - protein, 225 aa, Unknown
  Description of Unknown: Undetermined Phage F197/08 polypeptide
MFNVPVESITKGDPLRQKGKVSELALGYQGGAGALKAMGALEMGIEENELQGLVDSWRNANPNIVNFWKACQEAAINTVKSRKTHHTHGLRFYMKKGFLMIELPSGRALAYPKASVGENSWGSQVVEFMGLDLNRKWSKLKTYGGKLVENIVQATARDLLAISIARLEASGFKIVGHVHDEVIVEIPRGSNGLKEIETIMNKPVDWAKGLNLNSDGFTSPFYMKD

SEQ ID NO: 478 - protein, 61 aa, Unknown
  Description of Unknown: Undetermined Phage F197/08 polypeptide
MQHQAYINASVDIRIPTEVESVNYNQIDKEKENLADYLFNNPGELLKYNVINIKVLDLEVE

SEQ ID NO: 479 - protein, 93 aa, Unknown
  Description of Unknown: Undetermined Phage F197/08 polypeptide
MMARRKVIRVRIKGKLMTLREVSEKYHISPELLRYRYKHKMRGDELLCGRKDSKSKDEVEYMKSQIKDEEKEREKIRKKSDFEPIPTKCESGI

SEQ ID NO: 480 - protein, 67 aa, Unknown
  Description of Unknown: Undetermined Phage F197/08 polypeptide
MKKKREKKSEKKAILNLYQRNVRAEYEEERKRRLRPWLYDGTPQKHSRDPYWFDVTYNQMFKKWSEA

SEQ ID NO: 481 - protein, 85 aa, Unknown
  Description of Unknown: Undetermined Phage F197/08 polypeptide
MSIISNRKVDMNETQDNVKQPAHYTYGDIEIIDFIEQVTAQYPPQLAFAIGNAIKYLSRAPLKNGHEDLAKAKFYVDRVFDLWEG

SEQ ID NO: 482 - protein, 66 aa, Unknown
  Description of Unknown: Undetermined Phage F197/08 polypeptide
MATQKQVDYVMSLQEQLELEDCEKYTDEQVKAMSHKEVSNVIENYKTSIRNEELYYECMSFGLPNC

SEQ ID NO: 483 - protein, 54 aa, Unknown
  Description of Unknown: Undetermined Phage F197/08 polypeptide
VAHTHVVNGTYYFHGHIVPGWQSVKKTFDTAEELEIYIKQHGLEYEEQKQLTLF

SEQ ID NO: 484 - protein, 84 aa, Unknown
  Description of Unknown: Undetermined Phage F197/08 polypeptide
MNNREQIEQSIISASAYNGNDTEGLLKEIEDVYKKAQAFDEILEGLPNAMQDALKEDIGLDEAVGIMTGQVVYKYEEEQENEEI

SEQ ID NO: 485 - protein, 56 aa, Unknown
  Description of Unknown: Undetermined Phage F197/08 polypeptide
MKKFNVQITYTGMIEETIEAESLEEAEFEADVIARLEAPFDCDEYEINVEEEQEND

SEQ ID NO: 486 - protein, 175 aa, Unknown
  Description of Unknown: Undetermined Phage F197/08 polypeptide
MTNTLQVKLLSKDARMPERNHKTDAGYDIFSAETVVLEPQEKAVIKTDVAVSIPEGYVGLLTSRSGVSSKTHLVIETGKIDAGYHGNLGINIKNDAQVYLTTNEQCFDIQGEMENSFVNNAKKKPFTINDYYEIYKGDKLAQLVIVPIWTPELKQVEEFESVSERGAKGFGSSGV

SEQ ID NO: 487 - protein, 57 aa, Unknown
  Description of Unknown: Undetermined Phage F197/08 polypeptide
VRERTKIIYRGWNKEIFILQGKNMNVIGLRQIFDELKRSYEGYKIVVIPIEVDFEIK

SEQ ID NO: 488 - protein, 95 aa, Unknown
  Description of Unknown: Undetermined Phage F197/08 polypeptide
VTQYLVTTFKDSTGLPHEHITVARDNQTFTVVEAESKEEAKEKYEARNVPVDGATNLNDIKSNIGIFHVEKVEPNEGMVDINIETMKPFEEADDD

SEQ ID NO: 489 - protein, 79 aa, Unknown
  Description of Unknown: Undetermined Phage F197/08 polypeptide
MINIPKMKFPKKYTEIISKKYKNKTPEEKAKIENDFIKDINDKDSEFYSPMMANMNEHELRAMLRMMPSLIDTGDDNDD

SEQ ID NO: 490 - protein, 128 aa, Unknown
  Description of Unknown: Undetermined Phage F197/08 polypeptide
MIKKLKNMNWFDIFIAGILRLFGVIALMLVVISPIYTVASYQNKEVHQGTITDKYNKRQDKEDKFYIVLDNKQVIENSDLLFKKKFDSADIQARLKVGDKVEVKTIGYRIHFLNLYPVLYEAKKVDKQ

SEQ ID NO: 491 - protein, 50 aa, Unknown
  Description of Unknown: Undetermined Phage F197/08 polypeptide
MIKQILRLLFLLAMYELGKYVTEQVYIMMTANDDVEAPSDFAKIRAEVSW

SEQ ID NO: 492 - protein, 352 aa, Unknown
  Description of Unknown: Undetermined Phage F197/08 polypeptide
MLDKVTQIETIKYDRDVSYSYAASRLSTHWTNHNMAWSDFMQKLAQTVRTKEDLTEYNKMSKSEQADIKDVGGFVGGYLKEGKRRAGQVMNRSMLTLDIDYAAQDMTDILSMFYDFAYCLYSTHKHREISPRLRLVIPLKRNVNADEYEAIGRKVADIVGMDYFDDTTYQPHRLMYWPSTSNDAEFFFTYEDLPLLDPDKILNEYVDWTDTLEWPTSSREESKTKRLADKQGDPEEKPGIIGAFCRAYTIEEAIETFIPDLYEKHSTNRYTYHEGSTAGGLVLYENNKFAYSHHNTDPVSGMLVNSFDLVRIHLYGAQDEETKTDTPVNRLPSYKAMQQRAQNDEVVKKAIN

SEQ ID NO: 493 - protein, 209 aa, Unknown
  Description of Unknown: Undetermined Phage F197/08 polypeptide
MKLLKKQLINDKMSDAMQDFDEIENSDDAWSETLEITSKGTFKASIPNIEIILRNDPNLKGKIAFNEFTKQIECLGKVPWNTNFKTRQWQDGDDSSLRSYIEKIYDIHHSGKTKDAIISVAMQNAYHPVRDYLNKISWDGHKRLEKLFIKYLGVEDTEVNRTTTKKALTAGIARVMEPGCKFDYMLTLYGPQGVGKSALLKKIRWCMVF

SEQ ID NO: 494 - protein, 243 aa, Unknown
  Description of Unknown: Undetermined Phage F197/08 polypeptide
MEMAELAATRKAEVEAIKHFISKQVDRFRVAYGHYIEDFPRQCIFIGTTNKVDFLRDETGGRRFWPMTVNPERVEVNWSKLTKDEIDQIWAEAKYYYEQGEELFLNPELEEEMRSIQSKHTEESPYTGIIDEYLNTPIPSNWEDLSIFERRRFYQGDVDMLPTGNVDYVERNKVCALEVFVECFGKDKGDSRGSMEIRKISNILRQLDNWSVYDGNKSGKIRFGKDYGVQIAYVRDESLEDLI

SEQ ID NO: 495 - protein, 64 aa, Unknown
  Description of Unknown: Undetermined Phage F197/08 polypeptide
MKESTLEKYLVKEITKLNGLCLKWVAPGTRGVPDRIIIMPEGKTFFVEMKQEKGKLHPLQKICA

SEQ ID NO: 496 - protein, 34 aa, Unknown
  Description of Unknown: Undetermined Phage F197/08 polypeptide
VHRQFENRDHTVYVLWNKEQVNTFIRMVGGTFGD

SEQ ID NO: 497 - protein, 70 aa, Unknown
  Description of Unknown: Undetermined Phage F197/08 polypeptide
MLVIAPKQVAKDTWVDEVDKWNHLNHLKVSLILGTPKERNDALNTEADIYVTNKENTKWLCDQYKKRMAI

SEQ ID NO: 498 - protein, 329 aa, Unknown
  Description of Unknown: Undetermined Phage F197/08 polypeptide
MVVIDELSTFKSPKSQRFKSIKKKLPLINRFIGLTGTPSPNSLQDLWAQVYLIDRGERLESSFSRYRERYFKPTHQVSEHVFNWELRDGSEEKIYERIEDICLSMKAKDYLDMPDRVDTKQTVVLSEKERKVYEELEKNYILESEEEGTVVAQNGASLSQKLLQLANGAVYTDDEDVRLIHDKKLDKLEEIIEESQGQPILLFYNFKHDKERILQRFKEATTLEDSNYKERWNSGDIKLLIAHPASAGHGLNLQQGGHIIVWFGLTWSLELYQQANARLYRQGQNHTTIIHHIMTDNTIDQRVYKALQNKELTQEELMKAIKARIAKHK

SEQ ID NO: 499 - protein, 145 aa, Unknown
  Description of Unknown: Undetermined Phage F197/08 polypeptide
MGNTIYDIKPGTFKYIESEIYNLNENKKEIKRLRLEILNPTKEQDSNIVYGPLQKGEPVRTTELMATRLLTNKMLRNLEEMVEAVESEYLKLPEDHKKVIRLKYWNKEKKLKMEQIGHECHMHRNTVTTIRKNFVKAVAYHAGIK

SEQ ID NO: 500 - protein, 110 aa, Unknown
  Description of Unknown: Undetermined Phage F197/08 polypeptide
MTKHNNIYKHGRKSYQYDWFYHSKAWKKLREIALDRDNYLCQMCLREDIVTDANIVHHIIYVDEDFNKALDLDNLMSVCYSCHNKIHANDNDKSNLKKIRVLKNLNKKII

SEQ ID NO: 501 - protein, 77 aa, Unknown
  Description of Unknown: Undetermined Phage F197/08 polypeptide
LYIETYEFYCRLRDELKNSDLMIEHTNKAGASNIIKNPLSIELTKTVQTLNNLLKSMGLTAAQRKKIVQEEGGFGDY

SEQ ID NO: 502 - protein, 116 aa, Unknown
  Description of Unknown: Undetermined Phage F197/08 polypeptide
VTIKVLNEPSPKLLTTWYAEQVTQGKIKTSKYVRKECERHLRYLENGGKWVFDEELAHRPIRFIEKFCKPSKGSKRQLVLQPWQHFIIGSLFGWVHKETKLRRFKEALIFMGRKKW

SEQ ID NO: 503 - protein, 61 aa, Unknown
  Description of Unknown: Undetermined Phage F197/08 polypeptide
MKQARILFDESKAMIKASPKLDKNFRTLRDEIHYDATISKIMPQASDSDKLDGLNTHMGIF

SEQ ID NO: 504 - protein, 59 aa, Unknown
  Description of Unknown: Undetermined Phage F197/08 polypeptide
LISVIKNSRAARLQPLLIYITTAGYQLDGPLVDMVEAGRDTLDQIIEDERTFLLFSIFG

SEQ ID NO: 505 - protein, 71 aa, Unknown
  Description of Unknown: Undetermined Phage F197/08 polypeptide
LDDDDDINDSSNWIKANPNLGVSINLDEMKEEWEKAKRTPAERGDFITKRFNIFANNDEMSFIDYPTLQKK

SEQ ID NO: 506 - protein, 128 aa, Unknown
  Description of Unknown: Undetermined Phage F197/08 polypeptide
LITQHSKKNNEIVSLEELEGRPCTIGYDLSETEDFTAACATFALDNGKVAVLSHSWIPKHKVEYSNEKIPYREWEEDGLLTVQDKPYIDYQDVLNWIIKMNEHYVVEKITYDRANAFKLNQELKKLRV

SEQ ID NO: 507 - protein, 89 aa, Unknown
  Description of Unknown: Undetermined Phage F197/08 polypeptide
LSPALKDLKEMFLDGKIIFNNNPLMKWYINNVQLKLDRNGNWLPSKQSRYRKIDGFAAFLNTYTDIMNKVVSDSGEGNIEFISIKDIMR

SEQ ID NO: 508 - protein, 209 aa, Unknown
  Description of Unknown: Undetermined Phage F197/08 polypeptide
VNVIAKENIVTRIKKKLIDNWIDQSTSKLYDFSPWKNRSFWGVINNTLETNETIFSAITKLSNSMASLPLKMYEDYKVVNTEVSDLLTVSPNNSLSSFDFINQIETIRNEKGNAYVLIERDIYHQPSKLFLLNPDVVEMLIENQSRELYYSIHAATGNKLIVHNMDMLHFKHIVASNMVQGISPIDVLKNTTDFDNAVRTFNLTEMQKT

SEQ ID NO: 509 - protein, 24 aa, Unknown
  Description of Unknown: Undetermined Phage F197/08 peptide
MLKYGSNVGKEKKAASVRRFQTVL

SEQ ID NO: 510 - protein, 127 aa, Unknown
  Description of Unknown: Undetermined Phage F197/08 polypeptide
MQDQIQISRKNEELNRFYLQHTLLPIVKQYEEEFNRKLLTKTDREKNRYFKFNVKSYLRADSATQAEVYFKAVRSGYYTINDIREWEDLPPVEGGDKPLISGDLYPIDTPLELRKSLKGGDKNVNES

SEQ ID NO: 511 - protein, 82 aa, Unknown
  Description of Unknown: Undetermined Phage F197/08 polypeptide
MSMKAKYFQMKRKSKSKGEIFIYGDIVSDKWFESDVTATDFKNKLDELGDISEIDVHINSSGGSVFEGHAIYNMLKNASCKN

SEQ ID NO: 512 - protein, 207 aa, Unknown
  Description of Unknown: Undetermined Phage F197/08 polypeptide
MHPAKINIYVDALAASIASVIAMSGDTIFMHKNSFLMIHNSWVMTVGNAEELRKTADLLEKTDAVSNSAYLDKAKDLDQEHLKQMLDAETWLTAEEALSFGLIDEILGANEIAASISKEQYKRFENVPEDLKKDVDKITKIDDVDTSELVETPKESMSLEEKRKKEKKIKRECEILKNDNELLGGNEMPTLYELKQSLGMIGQQLKK

SEQ ID NO: 513 - protein, 339 aa, Unknown
  Description of Unknown: Undetermined Phage F197/08 polypeptide
LSQKATDPNIDMEDIKQLETEKAGLQQRFNIVERQVQDIEEKEKAKVKDKGEAYQSLSDNEKMVKAKAEFYRHAILPNEFEKPSMEAQRLLHALPTGNDSGGDKLLPKTLSKEIVSEPFAKNQLREKARLTNIKGLEIPRVSYTLDDDDFITDVETAKELKAKGDTVKFTTNKFKVFAAISDTVIHGSDVDLVNWVENALQSGLAAKERKDALAVSPKSGLEHMSFYNGSVKEVEGADMYDAIINALADLHEDYRDNATIYMRYADYVKIISVLSNGTTNFFDTPAEKVFGKPVVFTDAAVKPIVGDFNYFGINYDGTTYDTDKDVKKRRIFVCINSMV

SEQ ID NO: 514 - protein, 54 aa, Unknown
  Description of Unknown: Undetermined Phage F197/08 polypeptide
MSLEEIKLWLRIDYNFENDLIEGLIQSAKSELLLSGVPDYDKDDLEYPLFLYSD

SEQ ID NO: 515 - protein, 88 aa, Unknown
  Description of Unknown: Undetermined Phage F197/08 polypeptide
MKRKKMKLYSCFCKIYNPSMKDREILKATESKSGLTIIMRSSKIEYLPQTNHLVKIDRGLYSDKLFNIKEIRIDTPDIGYNTVVLSEK

SEQ ID NO: 516 - protein, 50 aa, Unknown
  Description of Unknown: Undetermined Phage F197/08 polypeptide
MSVEIKGIPEVLKKLESVYGKQSMQAKSDRALNEASEFFYKGFKERIREF

SEQ ID NO: 517 - protein, 86 aa, Unknown
  Description of Unknown: Undetermined Phage F197/08 polypeptide
MKHLNFFIKALKKEFESFKDTGASIEEMTKSKPYTKVGSQERAVLIEWVGPMNRKNIIHLNEHGYTRDGKKIYTKRFWSYCKNISC

SEQ ID NO: 518 - protein, 131 aa, Unknown
  Description of Unknown: Undetermined Phage F197/08 polypeptide
MNILNTIKGILLSDAELKTHINSRIYYYKVTENAETSKPFVVITPVYDLPSDFMSDKYLSEEYLIQIDVESSNNQKTIDITKRIRYLLYQQNLIQASSQLDAYFEETKRYVMSRRYQGIPKNIYYKNQRIE

SEQ ID NO: 519 - protein, 131 aa, Unknown
  Description of Unknown: Undetermined Phage F197/08 polypeptide
MAEGQGSYKVGFKRLYVGVFNPEATKVVKRMTWEDEKGGTVDLNITGLAPDLVDMFASNKRVWMKKQGTNEVKSDMSIFNIPSDDLNTVIGRTKDKKWYILGRREYKSTVCNSNWRIGRWFNRSAGICSLT

SEQ ID NO: 520 - protein, 39 aa, Unknown
  Description of Unknown: Undetermined Phage F197/08 polypeptide
MNRKVDVDGTSQGIVYGYHEGKEGETEFFKKSIRWIHGQ

SEQ ID NO: 521 - protein, 33 aa, Unknown
  Description of Unknown: Undetermined Phage F197/08 polypeptide
VKIIQRILQVRYPANPQNVEVAVNSKSATVSAE

SEQ ID NO: 522 - protein, 151 aa, Unknown
  Description of Unknown: Undetermined Phage F197/08 polypeptide
MTKTLKVYKGDDVVASEQGEGKVSVTLSNLEADTTYPKGTYQVAWEENGKESSKVDVPQFKTNPILVSGVSFTPETKSITVNADDNVEPNIAPSTATNKTLKYTSEHPEFVTVDERTGAIHGVAEGTSVITATSTDGSDKSGQITVTVTNG

SEQ ID NO: 523 - protein, 116 aa, Unknown
  Description of Unknown: Undetermined Phage F197/08 polypeptide
MIKFEIKDRKTGKTESYTKEDVTMGEAEKCYEYLELVNQENKKEAPNATKMRQKERQLLVDLFKDEGLTEEDVLNKMSTKTYTKALQDIFREINGEDEEDSETEPEEMGKTEEQSQ

SEQ ID NO: 524 - protein, 36 aa, Unknown
  Description of Unknown: Undetermined Phage F197/08 polypeptide
MEQYGWTLTEVRKQPYVKLLEILNEENKEETEEKTK

SEQ ID NO: 525 - protein, 61 aa, Unknown
  Description of Unknown: Undetermined Phage F197/08 polypeptide
MNEKVEGMTLELKLDHLGVQEGMKGLKRQLGVVNSEMKANLSAFDKSEKINGKNIRRELRG

SEQ ID NO: 526 - protein, 53 aa, Unknown
  Description of Unknown: Undetermined Phage F197/08 polypeptide
MIGLKFKKKMYSQVEDELKQVNANYQKAKSSVKDVEKAYLKLVEANKKRKISS

SEQ ID NO: 527 - protein, 54 aa, Unknown
  Description of Unknown: Undetermined Phage F197/08 polypeptide
LRDAEQKLKNSNQATTAQLKRASDAVQKQSAKHKALVEQYKQEGNQVQKTKSAK

SEQ ID NO: 528 - protein, 327 aa, Unknown
  Description of Unknown: Undetermined Phage F197/08 polypeptide
MKTFNKEQMIAQSHFGKLASQADVMSKKFSSIGDKMTSLGRTMTMGVSTPITLGLGAALKTSADFEGQMSRVGAIAQASSKDLKSMSNQAVDLGAKTSKSANEVAKGMEELAALGFNAKQTMEAMPGVISAAEASGAEMATTATVMASAINSFGLKASDANHVADLLARSANDSAADIQYMGDALKYAGTPAKALGVSIEDTSAAIEVLSNSGLEGSQAGTALRASFIRLANPSKNTAKEMKKLGIHLSDAKGQFVGMGELIRQFQDNMKGMTREQKLATVATIVGTEAASGFLALIEAGPDKINSYSKSLKNSNGESKKSSRFDER

SEQ ID NO: 529 - protein, 216 aa, Unknown
  Description of Unknown: Undetermined Phage F197/08 polypeptide
MAKVKKAADLMKDNLKGALEQLGGAFESLAIEVGKDLTPMIRAGAEGLTKLVDGFTHLPGWVRKASVGLALFGAAIGPAVLAGGLLIRTVGSAAKGYASLNRRIAENTILSNTNSKAMKSLGLQTLFLGSTTGKTSKGFKGLAGAMMFNLKPINVLKNSAKLAILPFKLLKNGLGLAAKSLFAVSGGARFAGVALRFLTGPIGATITAITIAYKVF

SEQ ID NO: 530 - protein, 68 aa, Unknown
  Description of Unknown: Undetermined Phage F197/08 polypeptide
LRIKFFKTAYDRVEWFRNGINGLGETIKFFGGKIIGGAVRKLGEFKKLSWKYRQKLQRKVFKRYERWL

SEQ ID NO: 531 - protein, 36 aa, Unknown
  Description of Unknown: Undetermined Phage F197/08 polypeptide
MKDGYKSLSDDDLLKVGVNKFKGFMQTMGTASKKSV

SEQ ID NO: 532 - protein, 49 aa, Unknown
  Description of Unknown: Undetermined Phage F197/08 polypeptide
VLGKGVSKETEKALEKYVHYSEENSRIMEKVRLNSGQISEDKAKKTFEN

SEQ ID NO: 533 - protein, 24 aa, Unknown
  Description of Unknown: Undetermined Phage F197/08 peptide
MTCELKKEQELNQKIKELKEKSFE

SEQ ID NO: 534 - protein, 128 aa, Unknown
  Description of Unknown: Undetermined Phage F197/08 polypeptide
LSDGQISENERKEIEKLENQRRDITVKELSKTEKEQERILVRMQRNRNAYSIDEASKAIKEAEKARKARKKEVDKQYEDDVIAIKNNVNLSKSEKDKLLAIADQRHKDEVRKAKSKKDAVVDVVKKAK

SEQ ID NO: 535 - protein, 98 aa, Unknown
  Description of Unknown: Undetermined Phage F197/08 polypeptide
MALKVGGLTLEKTKRKKSDKYAKEQEETARRNRENIKKWFGNAWDGVKSKTGEAFSKMGRNANHFGGEMKKNVERNQRDSKQIKFRLELSQKFCRIPH

SEQ ID NO: 536 - protein, 358 aa, Unknown
  Description of Unknown: Undetermined Phage F197/08 polypeptide
MWSGIKGIPSKLSSGWSSAKSSVGYHTKAIANSTGKWFGKAWQSVKSTTGSIYNQTKQKYSDASDKAWAHSKSIWRGTSKWFSNAYKSAKGWLTDMANKSRAKWDNISSTAWSNAKSVWKGTSKWFSNSYKSLKDWTGDMYSRAHDRFDAISSSAWSNAKSVFNGFRKWLSKTYDWIRDIGKDMGRAAADLGKNVANKAIGGLNSMIGGINKISKAITDKNLIKPIPTLSTGTLAGKGVATDNSGALTQPTFAVLNDRGSGNAPGGGVQEVIHRADGTFHAPQGRDVVVPLGVGDSVINANDTLKLQRMGVLPKFHGGTKKKDWLDQLKGNIGKKAGEFGATAKNTAHNIKKRCRRNG

SEQ ID NO: 537 - protein, 75 aa, Unknown
  Description of Unknown: Undetermined Phage F197/08 polypeptide
MVEAAGDKIKDGASWLGDKIGDVWDYVQHPGKLVNKVMSGLNINFGGGANATVKIAKGAYSLLKKEISRQSKIVV

SEQ ID NO: 538 - protein, 300 aa, Unknown
  Description of Unknown: Undetermined Phage F197/08 polypeptide
MPSGTNVYAVKGGIADKVWTDYGGGNSIQIKTGANEWNWYMHLSKQLARQGQRIKAGQLIGKSGATGNFVRGAHLHFQLMQGSHPGNDTAKDPEKWLKSLKGSGVRSGSGVNKAASAWAGDIRRAAKRMGVNVTSGDVGNIISLIQHESGGNAGITQSSALRDINVLQGNPAKGLLQYIPQTFRHYAVRGHNNIYSGYDQLLAFFNNRYWRSQFNPRGGWSPSGPRRYANGGLITKHQLAEVGEGDKQEMVIPLTRRKRAIQLTEQVMRIIGMDGKPNNITVNNDTSTVEKIVETNCYVK

SEQ ID NO: 539 - protein, 56 aa, Unknown
  Description of Unknown: Undetermined Phage F197/08 polypeptide
MLSDKGNKLTDALIQTVSSQDNNLGSNDAIRGLEKILSKQSGHRANANNYMGGLTN

SEQ ID NO: 540 - protein, 65 aa, Unknown
  Description of Unknown: Undetermined Phage F197/08 polypeptide
MQSFVKIIDGYKEEVITDFNQLIFLDARAESPNTNDNSVTINGVDGILPGAISFAPFFISIKVWL

SEQ ID NO: 541 - protein, 156 aa, Unknown
  Description of Unknown: Undetermined Phage F197/08 polypeptide
MPGVKYAVNTANVTSNLKDGSSTEIEVSLNVYKGYSESVNWTDSEFLFDSNWMFENGIPLDFTPKYTHTSNQFTIWNGSTDTINPRFKHDLKILINLNASGGFELVNYTTGDIFKYNKSIDKNTDFVLDGVYAYRDINRVGIDTNRGIITLAPGKK

SEQ ID NO: 542 - protein, 141 aa, Unknown
  Description of Unknown: Undetermined Phage F197/08 polypeptide
MDYHDHLSVMDFNELICENLLDVDYGSFKEYYELNEARYITFTVYRTTHNSFVFDLLICENFIIYHGEKYTIKQTAPKVEGDKVFIEVTAYHIMYEFQNHSVESNKLDDDSSETGKTPEYSLDEYLRYGFANQKNFGQNDL

SEQ ID NO: 543 - protein, 153 aa, Unknown
  Description of Unknown: Undetermined Phage F197/08 polypeptide
MTYKIIGDFKRKVPIDELGNKNGLEYCKEAVDLFGCIIYPNDTEIGFYSPETFYQRSEKVIRYQYNTDTVSATVSTLELRTAIKVFGKKYTAEEKKNYNPIRTTDIKYSNGFIKEGTYRTETIGSKATINFDCKYGNETVRFTIKKGLSRWNI

SEQ ID NO: 544 - protein, 57 aa, Unknown
  Description of Unknown: Undetermined Phage F197/08 polypeptide
LILDGKQIKQISCFAKSVQSETIDLIKNIDKGKHVLEMIFLGEDPKNRIDISSNKKS

SEQ ID NO: 545 - protein, 64 aa, Unknown
  Description of Unknown: Undetermined Phage F197/08 polypeptide
MLELKKSTVLNLIADNSGRNQYKAIVDYVADSAKQFGIRYANTQTNEDIETQDKLLEFAKKANK

SEQ ID NO: 546 - protein, 117 aa, Unknown
  Description of Unknown: Undetermined Phage F197/08 polypeptide
LQKKQINDTPKTELDVNYIGYEKIEPRDSVFFVHELMGYNTELKVVKLDRSHPFVNAIDEVSFSNEIKDMVQIQQALNRRVIAQDNRYNYQANRINHLYTSTLNSPFETMDIGSVLI

SEQ ID NO: 547 - protein, 96 aa, Unknown
  Description of Unknown: Undetermined Phage F197/08 polypeptide
MATEEVKIKALLENDKQYFPATHWKAINGIPYAGSSDIDGLPQDGIISVDDKNKLDKLKIGEAGIIQNSIVQKSPNGKLWKITVDDSGKLGTVLFY

SEQ ID NO: 548 - protein, 208 aa, Unknown
  Description of Unknown: Undetermined Phage F197/08 polypeptide
MENLYLIKDLGALAGRDYRAKEIQNLQRIEQFALGLTTEFKLHQKAKTMQHFAEQIYYNGRSQAAVNKSLQSQINALVVAPRNNSANEIVQARVNVNGETFDTLKEHLDDWETKTQINKEETIRELNKTKQEILDIEYRFEPDKQEFLFVTELAPLTNAVMQSFWFDNRTGIVYMTQARNNGYMLSRLRPNGQFIDSSLIVGGGSWYT

SEQ ID NO: 549 - protein, 72 aa, Unknown
  Description of Unknown: Undetermined Phage F197/08 polypeptide
VGGHGTHNGYRYIDDELWIYSFILNGNNENTLVRFKYTPNVEISYGKYGMQDVFTGHPEKPYITPVINEKRK

SEQ ID NO: 550 - protein, 140 aa, Unknown
  Description of Unknown: Undetermined Phage F197/08 polypeptide
MKKENKILYRIERPRSQWELENSMNYIEIRSLDDVDKNIDKVLHKISIPMRLTNETQPMQGVTFDEKYLYWYTGDSNPNNRNYLTAFDLETGEEAYQVNADYGGTLDSFPGEFAEAEGLQIYYDKDSGKKSFDARCYCRW

SEQ ID NO: 551 - protein, 166 aa, Unknown
  Description of Unknown: Undetermined Phage F197/08 polypeptide
MTKIVVKKALMLGVTVGGDGNRTHRIFMIGQRGILEILHSRGVPFIMSDTGGRVKPLPMRPDKLKNLGMLTEPGLYYLYTDHTVQIDDFPLPREWRDAGWFLEVKPPQTGGDVIQILTRNSYARNMMTFERVLSGRTGDISDWNYVPKNSGKWERVPSFITKNVRY

SEQ ID NO: 552 - protein, 84 aa, Unknown
  Description of Unknown: Undetermined Phage F197/08 polypeptide
MSDINIVGMSFYLTTDDTKRFTDFPTERKGVAGWNLYVEASNTGGFVHRLVRNSVTASAEILLKNYDSKTSSGPWTLHEGRIIS

SEQ ID NO: 553 - protein, 67 aa, Unknown
  Description of Unknown: Undetermined Phage F197/08 polypeptide
MSNLEKSVAINLENTAHYENISNLDITFRTGESDSSVLLFNIIKNNQPLLLSEENIKARIAIRGKGV

SEQ ID NO: 554 - protein, 155 aa, Unknown
  Description of Unknown: Undetermined Phage F86/06 polypeptide
MAGRPKKLLSNSNKNYTKEEIIEKERQEAQLNKFSKIDTEPPHFLDEIAKQEYLRILPHMQELPISNLDKAQLAQYCSFYSDFVKASLILEREDLILEDDKGNQKVNPAFNIKEKAGIRLQQTANTLGLTIDSRLRIMVPDEKEDDDPYMEFVSD

SEQ ID NO: 555 - protein, 564 aa, Unknown
  Description of Unknown: Undetermined Phage F86/06 polypeptide
MTDYVTKYAKKVVSGEILASLKNIQVCKRHLSFMENPPNGCHWDNHLSNKAIKFVEMLPDPKTNQPMPLMEFQKFIVGSLYGWRRGQYRMFTKAYISMARKQGKSLIVSGMSVNELLFGQYPKFNRQIYVASSTYKQAQTIFKMASQQVNLMRSKSKFIREKTDVRKTDIEDVLSSSVFAPLSNNPDAVDGKDPTVAILDELASMPDDEMYSRFKTGMTLQKNPLTLLVSTAGDNLNSQMYQEYKYIKRILNEEVRADNYFVYCAEMDSQEEVQDETKWIKAMPLLESKEHRKTILQNVKADIQDELEKGTSYHKILIKNFNLWQAQREDSLLDISDWEQVITPMPNINGKDVYIGVDLSRLDDLTSVGFIFPNDDKKVFLHSHSFIGLRTNLEQKSKRDKINYELAIERGEAETTQSDSGMIDYKQVIDFIVKFITTHDLNVQAVCYDPWNAQSFITTIESMALDWPLIEVGQSFKALSQSIKEFRMWVADERIQHNDNMLLTTSVNNAVLIRDGEDNVKINKKMNRQKIDPIISIITAFTEARMHEFQENWTEKYESEEFGF

SEQ ID NO: 556 - protein, 79 aa, Unknown
  Description of Unknown: Undetermined Phage F86/06 polypeptide
MKAKNSDFKGGDKMDLNKINVFFNFLVANLVSILFLLGLFVVNVSMYKAFGQNIGLLCIGITLIVISLILNHESNQERS

SEQ ID NO: 557 - protein, 416 aa, Unknown
  Description of Unknown: Undetermined Phage F86/06 polypeptide
VGIFYKNEKRDLQYNEDDLQMMVQTLPGFQGTKLRQYKDIEAIRHSDIFTAVMMIASDLARMPIRVTVNGQINYSDRIVNLLNTRPNPMYNGYIFKLVVFVSALLTSHGYIEITRDKTGEPMNLTFRKTSEIELKSDARGRLYYFHQRIDSNGNNIERNVKFEDMLDIKFYSLDGINGLSLLDTLSRTIESDNNGKDFLNNFLRNGTHAGGILKMKGVLDNKKARDRAREEFHKSFSGTKQAGKVVVLDESMTFDQLEVDTEVLKLIRENKSSTREIAGVFGIPLHKFGIETANMSITDANLDYLSTLKPYITCVCAELNFKFNDEYVNREFKFDTTEIRVVDEKTQAEIDKINIDSGKMNIDEIRQRDGLAPIPGGNGSIHRVDLNHVNIELVDEYQMNKSRATDKKLKGGEENE

SEQ ID NO: 558 - protein, 194 aa, Unknown
  Description of Unknown: Undetermined Phage F86/06 polypeptide
MSKETRVGNIIEVRSNDNNEMVIEGYALKFDTWSENLGGFKETISRRALENTDLSDVRCLVDHIPSQIIGRTKSGTLELETDDVGLKYRCKLPNTTFARDLYENMRVGNINQCSFGFMLDDKGDEVRFDEQENIYKRTLTAIRELTDVSVVTYPAYKDTDVKPALRSIETVKKEQRKKELEIRLKKHSILNNIW

SEQ ID NO: 559 - protein, 415 aa, Unknown
  Description of Unknown: Undetermined Phage F86/06 polypeptide
MKTKEELQSEISDIKRQIDLKVKYATRALNNDELEKAEKLEQEITDLRSQIQEKQEELDKLKEKDGTSENNQQSVEVNEARTYRNQANINDLGISIQNTKVTSQEVRDFTEYLETRNDIQGGSLKTDSGFVVIPEEIVTDILKLKEVEFNLDKYVTVKRVTNGSGKYPVVRQSEVAALEKVEELEENPELAVKPFFQLAYDINTHRGYFRISREAIEDAKVNVLQELKLWMARTIAATRNKAIIDVITKGSTGSTSSGFEKEGKKLEVKKAKSLDDIKDAINLNVKPNYEHNVAIVSQTMFAKLDKMKDKLGNYLIQPDVKEKTQQRLLGAKIEILPDEVLGQKGNNTLIIGNLKDAIVLFDRSQYQASWTDYMHFGECLMIAVRQDCRILDYKSAIVIEYDDSERGEGDLGLEA

SEQ ID NO: 560 - protein, 52 aa, Unknown
  Description of Unknown: Undetermined Phage F86/06 polypeptide
MAMYEVKKSYTDLEKGQYLKSGKRVEMTVKRAEYVNKKLKEHGVILERVKEE

SEQ ID NO: 561 - protein, 110 aa, Unknown
  Description of Unknown: Undetermined Phage F86/06 polypeptide
MQLTAEELKLLKKHCKIDHNSEDDLLEIYYSWAFHEIASAVTDEPSKYIDWFKSHPLFARAIYPLASYYFENRIAYLDRDLSLAPHMVLSTVHKLRGSFEQFLESENDEI

SEQ ID NO: 562 - protein, 111 aa, Unknown
  Description of Unknown: Undetermined Phage F86/06 polypeptide
MMKFNSNKLNERIDFCEDVSERVNGNPMKPKTKILYSCFACIQESKESDTQTNLNTGSKFIKTIIIRDTRGDYKPTNKHYVLHEGQRFNIKYVKPDYQDKSYLRIYGEVVI

SEQ ID NO: 563 - protein, 125 aa, Unknown
  Description of Unknown: Undetermined Phage F86/06 polypeptide
MGARIESNNIEQGLKNAVLKMNLNSNVIVKAGAMSLVPLLKSNTPFADTKKHARDHIAVSNVKTDRDTSEKIVTIGYAKGVSHRIHATEFGTMYQKPQLFITKTEKQGKNKVLKTMLDTAKRLQK

SEQ ID NO: 564 - protein, 126 aa, Unknown
  Description of Unknown: Undetermined Phage F86/06 polypeptide
MINVTKIIRNAIIANNITDEVNVFNYTIDDHFHEKTDKPIIRIYPLPFNPDTYADDNEISREYHYQIDVWWSQDEPNEQAEKIVELLKVINFQCYYREPLYESDVMSFRHIIRAKGSILSMKLEEN

SEQ ID NO: 565 - protein, 317 aa, Unknown
  Description of Unknown: Undetermined Phage F86/06 polypeptide
MIEKLKQAPRFLKLNLQHFADTGVSGIAIGVSNFYYAPILKDTENEWETGAGTRIRFLKEIEVDRPQDTEEDYGDDMVAATAVSNGKLSVKTTFVTVPADDKAFLNGAKKGVGGYKYGAKDIPPDVAIVFERRNHDESSEWVGLFKGKFTRSSIKGQTKQDKVEFQNDDVEGNFIDRLFDESSHVTGYDKKGSTTGRDYVFMETFGKTYDEFMSSRGEQNMEPVEKEMKKTEKVEVTSVNVTDEQVTVKVDATKQLSATTEPSGQKVTYAVTEGQTYASVTSTGLVKGLAEGNATVTATAGKQTDTVQITVQSNLEM

SEQ ID NO: 566 - protein, 148 aa, Unknown
  Description of Unknown: Undetermined Phage F86/06 polypeptide
MERTSIELITGFTKTGKPQYQKYLAKPIITLFETIQGSKLGLKLNKAFKGADFKDLTEEEFNNLSVTEQEEYKNKQEEYENNMAVQMEVLEEVLDFIVEAFDNQFTSIELQKGLPNGQEGIEKIGQLIGRITGGEPSDTKKFVTENQK

SEQ ID NO: 567 - protein, 1549 aa, Unknown
  Description of Unknown: Undetermined Phage F86/06 polypeptide
MPNPIGNMVIKVDLDGSGFNRGVTGLNRQMKMVSRELSANLSQFSRYDNSLEKSKIKVEGLSKKQKVQAQITKELKDSYDKLSKETGENSAKTQAAAAKYNEAYAKLNQYERELNQATQELKDMQREQKALNTAMGKLGTNFNNFGPKLQEIGNSMKNVGRNMTMYVTAPVVAGFAVAAKKGIEFDDSMRKVKATSGATGEEFEALKKKAREMGATTKFSASDSAEALNYMALAGWDSKQMMEGLSGVMDLAAASGEELGAVSDIVTDGLTAFGLKAKDSGHFADVLAQTSSKANTDVRGLGEAFKYVAPVAGALGYTIEDTSIAIGLMSNAGIKGEKAGTALRTMFTNLSSPTRAMGNEMERLGISITDSNGKMIPMRKLLDQLREKFKHLSKDQQASSAATIFGKEAMSGALAIINASDEDYQKLTKSIDSSTGASKRMADTMESGLGGKLRTLRSQLEELALTIYDRIEPALKIIVSAFSKVVTWVTKLPTSIQLAVVGFGLFAAVLGPLVFMFGLFISVMGNAMTVLGPLLINVNKAGGIFAFLRTKIASLVKLFPILGVSISSLTLPITLIVGALVGIGIAFYQAYKRSETFRNIVNQAISGVANAFKAAKLALQGFFDLFKGDSKGAVTLEKIFPPETVAGIQNVVNTIRTTFFKVVDAIVGFAKEIGAQLASFWKENGSEITQALQNIAGFIKATFEFIFNFIIKPIMFAIWQVMQFIWPAVKALIVSTWENIKGVIQGALNIILGFIKFFSSLFTGNWRGVWDGIVMILKGTVQLIWNLIQLWFVGKILGVVRYFGGLLKGLISGIWSVIKGIFTKSLSAIWNATKSIFGFLYNSVKSIFTNMKNWLSSTWNNIKSNTVGKAHSLFTGVRSKFTSLWNATKDIFTKLRNWMSNTWNSIKDNTVGIAGRLWDKVRNIFGNMRDGLKSIIGKIKDHIGGMVDAIKKGLNKLIEGLNWVGGKLGMDEIPRLHTGTEHTHTTTRLVKNGKITRDTFATVGDKGRGNGPNGFRNEMIEFPNGKRVITPNTDTTAYLPKGSKVYNGAQTYSMLNGTLPRFSIGTMWKDIKSGASSAFNWTKDQIGKGTKWLGDKVGDVMDFIDNPGKLLNYVLQAFGVDFSSLTKGMGIAGDITKAAWSKIKKSAIKWLEDAFAESGDGGVLDMNKLRYLYGHTAAYTRETGRPFHEGLDFDYIYEPVPSTINGRAQVMPFHNGGYGKWVKIVKGALEVIYAHLSKYKVKTGQQVRVGQTVGISGNTGFSTGPHLHYEMRWNGRHRDPLPWLRKNNGGGKSTPGGNGAANARRAIKAAQNILGGRYKASWITNEMMRVASRESNYTANAVNNWDSNARAGIPSRGMFQMIDPSFRAYAKSGYNNPLNPTHQAISAMRYIVGKWVPRTGSWRAAFKRAGDYAYATGGKVYNGLYHLGEEGYPEWIIPTDPSRANEAHKLLALAANDIDNRSKNKRPNNLPNPSISNSDTNYIHTLENKLDAVINCLVSLVESNQVIADKDYEPVINKYVFEDEVNNSIDKRERHESTRVRFRRGGTII

SEQ ID NO: 568 - protein, 496 aa, Unknown
  Description of Unknown: Undetermined Phage F86/06 polypeptide
MQDTIQIDNKTIEWLVVQRGFEIPSFNFVTEKESVKGRTGSIAKARYLNDIEFELPLIIRNEVLAPGGQKTHDDILEELVEFFDIDNLKPKKLKFKSQNWYWFAYFDGPLKLPKNPRGSVKFTIKVVLTDPYKYSVTGNKNTAISDQVSVVNSGTADTPLIVEARAIKPSSYFMITKNDEDYFMVGDDEVTKEVKDYMPPVYHSEFRDFKGWTKMITEDIPSNDLGGKVGGDFVISNLGEGYKATNFPDAKGWVGAGTKRGLPKAMTDFQITYKCIVEQKGKGAGRTAQHIYDSDGKLLASIGYENKYHDRKIGHIVVTLYNQKGDPKKIYDYQNKPIMYNLDRIVVYMRLRRVGNKFSIKTWKFDHIKDPDRRKPIDMDEKEWIDGGKFYQRPASIIAIYSAKYNGYKWMEMNGLGSFNTEILPKPKGARDVIIQKGDLVKIDMQAKSVVINEEPMLSEKSFGSNYFNVDSGYSELIIQPENVFDTTVKWQDRYL

SEQ ID NO: 569 - protein, 1260 aa, Unknown
  Description of Unknown: Undetermined Phage F86/06 polypeptide
VIHVLDFNDKIIDFLSTDDPSLVRAIHKRNVNDNSEMLELLISSERAEKFRERHRVIIRDSNKQWREFIINWVQDTMDGYTEIECIASYLADITTAKPYAPGKFEKKITSEALKDVLSDTGWEVSEQTEYDGLRTTSWTSYQTRYEVLKQLCTTYKMVLDFYIELSSNTVKGRYVVLKKKNSLFKGKEIEYGKDLVGLTRKIDMSEIKTALIAVGPENDKGKRLELVVTDDEAQSQFNLPTRYIWGIYEPQSDDQNMNETRLRSLAKTELNKRKSAVMSYEITSTDLEVTYPHEIISIGDTVRVKHRDFNPPLYVEAEVIAEEYNIISENSTYTFGQPKEFKESELREEFNKRLNIIHQKLNDNISNINTIVKDVVDSELEYFERKIHKSDTPPENPVNDMLWYDTSNPDVAVLRRYWNGRWIEETPNDVEKLGGITREKALFSELNNIFINLSIQHASLLSEATELLNSEYLVDNDLKADLQASLDAVIDVYNQIKNNLESMTPETATIGRLVDTKTLFLEYRKKLQDVYTDVEDVKIAISDRFKLLQSQYTDEKYKEALEIIATKFGLTVNEDLQLVGEPNVVKSAIEAARESTKEQLRDYVKTSDYKTDKDGIVERLDTAEAERTTLKGEIKDKVTLNEYRNGLEEQKQYTDDQLSDLSNNPEIKASIEQANQEAQEALKSYIDAQDDLKEKESQAYADGKISEEEQRAIQDAQAKLEEAKQNAELKARNAEKKANAYTDNKVKESTDAQRKTLTRYGSQIIQNGKEIKLRTTKEEFNASKRTLSRVLADITVNAMKGIYLRYDENGAITSHTIDKDGVKISGDKVDITANREFNVVANNINNKVGKNDIVNSLNLSNEGLDINVNRIGIKGGNANRYVQVQNDFIELGGIVQRTWKGKRSTDDIFTRLKDGHLRFRNNTAGGSLYMSHFGISTYIDGEGEDGGSSGTIQWWDKTYSDSGMNGITINSYGGVVALTSDYNRIIIDSYASANIESREAPIYLSPNTKNKPGLNRFAFTLSNADSAYETDGYIMFGSDENYKYGAGLRFSKRSNKGLVQVVNGDYATGGDTTIESGMGKFNIVKRRDGNSYVSIQSYDLLAVGSDNAGDRVASNSIYKRTYSAPANLHITSAGTIGRATSAKKYKISIENQYINEDDQFSHSKEILKLPIRTWFDKYESEIMAKELESGKKLSDDTFKLSRHTGLIAEEVEELGFNEFVIYDDNGEIEGIAYDRLWVHLIPIIKNQQSKIEKLEELINE

SEQ ID NO: 570 - protein, 50 aa, Unknown
  Description of Unknown: Undetermined Phage F86/06 polypeptide
MNDSNQGLQANPQYTIHYLSQEITRLTQENAMLKAYIQEQNEKSKSAEEE

SEQ ID NO: 571 - protein, 95 aa, Unknown
  Description of Unknown: Undetermined Phage F86/06 polypeptide
MANEIIKKTERFILVQIDKEGTERVLYQDFVGSFTTSDSASYAQDFKSEENAKKIAETLNLLYQLTVNQNGVKVVKEVVDRTDLSSDKSVDSEIM

SEQ ID NO: 572 - protein, 124 aa, Unknown
  Description of Unknown: Undetermined Phage F86/06 polypeptide
LDDIQKIKKELSELVERVDDVEILANETADHVLELREEHKQHHNELRESHKELKDKQDKVVDENLEQTKILNRIEERYQTQVDVAQKNEEKTLAQNKWLVGAIWALVTIVMIAVITASITALLP

SEQ ID NO: 573 - protein, 44 aa, Unknown
  Description of Unknown: Undetermined Phage F86/06 polypeptide
MLALLKSLERRCLMITISTMLQFGLFLIALIGLVIKLIELSNKK

SEQ ID NO: 574 - protein, 84 aa, Unknown
  Description of Unknown: Undetermined Phage F86/06 polypeptide
MINWKIRMKQKSFWVAILSAIFLFAQNIAKAIGYDIQVYTEQLTDGLNAILGFLVLTGVIQDPTTKGIGDSHQALEYEEPRRKY

SEQ ID NO: 575 - protein, 255 aa, Unknown
  Description of Unknown: Undetermined Phage F86/06 polypeptide
MKTYSEARARLRWYQGRYIDFDGWYGYQCADLAVDYIYWLLEIRMWGNAKDAINNDFKNMATVYENTPSFVPQIGDVAVFTKGIYKQYGHIGLVFNGGNTNQFLILEQNYDGNANTPAKLRWDNYYGCTHFIRPKYKSEGLMNKITNKVKPPAQKAVGKSASKITVGSKAPYNLKWSKGAYFNAKIDGLGATSATRYGDNRTNYRFDVGQAVYAPGTLIYVFEIIDGWCRIYWNNHNEWIWHERLIVKEVFSFLG

SEQ ID NO: 576 - protein, 163 aa, Unknown
  Description of Unknown: Undetermined Phage F86/06 polypeptide
MLKRSLLFLTVLLLLFSFSSITNEVSASSSFDKGKYKKGDDASYFEPTGPYLMVNVTGVDGKGNELLSPRYVEFPIKPGTTLTKEKIEYYVEWALDATAYKEFRVVELDPSAKIEVTYYDKNKKKEETKSFPITEKGFVVPDLSEHIKNPGFNLITKVVIEKK

SEQ ID NO: 577 - protein, 68 aa, Unknown
  Description of Unknown: Undetermined Phage F86/06 polypeptide
VRDGYSTNSRITGVLPNNATIKYDGAYCINGYRWITYIANSGQRRYIATGEVDKAGNRISSFGNFSAV

SEQ ID NO: 578 - protein, 209 aa, Unknown
  Description of Unknown: Undetermined Phage F86/06 polypeptide
MKIRKSILAGTLAIVLASPLVTNLDKNEAQASTSLPTSNEYQNEKLANELKSLLDELNVNELATGSLNTYYKRTIKISGLKANIWFLIIFVLTVLVFNPLIVKFIIWLINETRKFMNLDCISLLDKRDKLFNNNGKPVFIVIKDFENRIIEEGELKTYNSAGSDFDLLEVERQDFKVSDLPSNDELYIKHTLVDLKQQIKLDLYLMNEY

SEQ ID NO: 579 - protein, 48 aa, Unknown
  Description of Unknown: Undetermined Phage F86/06 polypeptide
LNGGENFMADKNKKQEATRSNPINKSFEKPGASENLKSTLSEKAKKKD

SEQ ID NO: 580 - protein, 60 aa, Unknown
  Description of Unknown: Undetermined Phage F86/06 polypeptide
MKITNCKIKRETIVYEVLTSGNQPFTYELPKDLSSHNARKYLEFISQKIDGDKLTKEDSL

SEQ ID NO: 581 - protein, 113 aa, Unknown
  Description of Unknown: Undetermined Phage F86/06 polypeptide
MIKKIFTKKHVFLVIEDENHNHSDAVFGKSILLSIYVGVNKKTNSKSGKFIYLDRSKRIVRQSDITKIESANENDVDFYNLLKKEKEIVYSKNIVDKYNLANYIIYYEVSTKE

SEQ ID NO: 582 - protein, 310 aa, Unknown
  Description of Unknown: Undetermined Phage F86/06 polypeptide
MKKYDIAVLDFETMNEHMNSPCEVAVSLIKDLSIVKVYSSYINPPNNRYNLKNAKIHKIPEDVILKAPKYPDIYQEILYLLKESHLIIAHNALFDISVLKNTNNYYDLPVPNFMYVDSINIFRSFHAISSFKLENLCSLYDIDKEKLHSAKFDVLALSKMLISLAKNNQHYSVLKLIHYMPKQYIRFSKYSNSPTKLFDSGFQKIHMKISEINKIEVESVIPILKDKNVVFTGNFDTEKQDLMILTRKKGAYIRSDVTAKTDILVEGVQDDKYKDVNGLVSKQRKAREYVGNGAKIQFLNEEDLINLIKE

SEQ ID NO: 583 - protein, 237 aa, Unknown
  Description of Unknown: Undetermined Phage F86/06 polypeptide
MNKERNIIIAKNIRKFLNDSNMSQKKLAELINIKPSTLSDYLNLRSNPSHGVIQRIADVFEVGKSDIDTTYKDDNDITSIYNKLTPPRQENVLNYANEQLEEQNSKGDNVVDINSYKQEKTPVNVNGCVSAGVGERLHDETLFTEMVKGPIPTHDLALKVNGDSMEPMFKDGEIIFVEKTHNIKNGQIGIFIIEEEAYVKKVFVEDDRLTLVSLNKDYDDLHFYRNESVRLIGKVIL

SEQ ID NO: 584 - protein, 87 aa, Unknown
  Description of Unknown: Undetermined Phage F86/06 polypeptide
MKTLKELRTDYGLTQKELGDLFKVSSRTIQNMEKDSTNIKDSLLSKYMSAFNVKYDDIFLGNEYENFVFTNDKKKSIILAFKEKQTS

SEQ ID NO: 585 - protein, 71 aa, Unknown
  Description of Unknown: Undetermined Phage F86/06 polypeptide
MNIQVATKLAMEKGISIRRENQDVYGILPTNLQRYQCLVVSRHYKKKRQTAAGRWQPSADDLIADDWILDY

SEQ ID NO: 586 - protein, 109 aa, Unknown
  Description of Unknown: Undetermined Phage F86/06 polypeptide
MTDEAKFVLLQLYSIYLDRIDEGMSKRSASYFGSDESSFNAFFLGFNFEDYIDAVLELKHRDFVIASAEDGGFLEMALSREGIAYSESESKKDYKTLMGLIRDLKKLII

SEQ ID NO: 587 - protein, 250 aa, Unknown
  Description of Unknown: Undetermined Phage F86/06 polypeptide
MQALQTKSNIGEMFNIQEKENGEIAISGRELHQALEVKTPYKKWFERMSDYGFEENIDYIVTDIFVHNPLGGRQNQTDHALTLDTAKEIAMIQRSEPGKRARQYFIQVEKAWNSPEMIMQRALKIANNTINQLETKIERDKPKIVFADAVATTKTSILVGELAKIIKQNGINIGQRRLFEWLRQNGFLIKRKGVDYNMPTQYSMERELFEIKETSITHSDGHTSISKTPKVTGKGQQYFVNKFLGEKQTS

SEQ ID NO: 588 - protein, 65 aa, Unknown
  Description of Unknown: Undetermined Phage F86/06 polypeptide
MQAQNKKVIYYYYDEAGNRRPVNIQYNDGYDLMIDPRFIEMTLERHPHLKNNFYGLIDGKEFKLD

SEQ ID NO: 589 - protein, 46 aa, Unknown
  Description of Unknown: Undetermined Phage F86/06 polypeptide
MLQKFRIAKEKNKLKLKLLKHASYCLERSNNPELLRAVAELLKKVN

SEQ ID NO: 590 - protein, 210 aa, Unknown
  Description of Unknown: Undetermined Phage F86/06 polypeptide
VYIDPLKNVRFSINNVISNVEISKSMAIKQSLKPKYQLDIINRNNINLFSDFKVDFHLNNLIEMNFNLRNSFSSLTFQRNLFSEETIKSFKELYRFDDEIVLQAQQTIRDFYINPTAISTLAEAINSTYPINEQSTYKRHDEFVKRIENDFPHPFKKLIRWSNGIAAGADIQIFVTNYINENDLHIQNSLIVAIVCLLSFLSTYCSHSKK

SEQ ID NO: 591 - protein, 106 aa, Unknown
  Description of Unknown: Undetermined Phage F86/06 polypeptide
MPHILNVTVPIPETHVLITKDEYDELIGYSLDPVWNMSDLKKKLKIASDETIKDRLLFHPRFEKELRAQGIVHYPDENFNRWRFNARKMNKFVDEHFNEIYKERIK

SEQ ID NO: 592 - protein, 53 aa, Unknown
  Description of Unknown: Undetermined Phage F86/06 polypeptide
MSNIYKSYLLAVLCFTVLAIVLMPLLYFTTAWSIAGFASIATFIFYKEYFYEE

SEQ ID NO: 593 - protein, 20 aa, Unknown
  Description of Unknown: Undetermined Phage F86/06 peptide
MKKLLLAPTSNSDKRLTKLI

SEQ ID NO: 594 - protein, 108 aa, Unknown
  Description of Unknown: Undetermined Phage F86/06 polypeptide
MTKNYKDMTQEELRDLLAEKNGELFEVVNEINKETEFAVLLFSTVGVSNGDTTSSSHCALGDIVGLANLLNNENDYHDIANVIEMYKLKKLLGLADNKEDENDVLQNG

SEQ ID NO: 595 - protein, 86 aa, Unknown
  Description of Unknown: Undetermined Phage F86/06 polypeptide
MYYKTGDVCQKIINVDGFDFRLRVKKRAYSVEIVVLDHEGNSIDGILVSDENDLYTALDILKQSIYEWIENNTDEQDKLMNLVMKW

SEQ ID NO: 596 - protein, 87 aa, Unknown
  Description of Unknown: Undetermined Phage F86/06 polypeptide
MRDTERNILNIFKTLFDEYTLSNQRALLEIERNHHGYLSINFLHYHDSYKTNNKLVQIHEINPDSHERIKNLIIEVLRGHRKIKKGA

SEQ ID NO: 597 - protein, 647 aa, Unknown
  Description of Unknown: Undetermined Phage F86/06 polypeptide
MKINKLTISNFAGIKEVTFNFDGKDAKIYGNNATGKTTTATALQWLLFDKGLDGSTKSFNPVPLNEKNAENYELIPTVFAEFEIDGKITTFKKESHPKYTINQKTNRKEYSRSRTKKQYINDESIKVKDYKARIDELIDEDVFKLITNPQAFNLLDWKKRRSLLFEIAKPINDEDVIKTNDDFKELNNILGDHEIETKKKILTDKIKQINKDIKDIPIRINQTQQNKQDVPEFDNDRYAIIKQEIEQLENERIDIQNGKEEINLRNQLADKQSELKRIEDNNSASNENKIHALTNELHVENGTVANLKTRLKQNKQQITHEENRRNQLLENHKGLKSDLEKSKNQKFEHLDDNVCSCCGQQLPTEQVNEAREKALQKFNVKKSKELETIQTSINHIISEGKKIKPIIEKLEDDNNNLQIKINEAEERSARIQNKINKLKTTHVDVTQTDEYKAVMLEINEINQKRSNIRKTIQDKVSGIDDKISELTQEKSEIEVSRSIEKSNKHLDDVISELRNEEDRLLDEKEKYSHDLYILKKFTTTKVKMLTENINNEFDIAEFKLFNTLVNGELEETCSTTVNGVEYDSGLNNASRINVGLDIINTLSKHFKVTAPIFIDNAESVTELIKTESQQIQLIVNEQDKKLRMETI

SEQ ID NO: 598 - protein, 306 aa, Unknown
  Description of Unknown: Undetermined Phage F86/06 polypeptide
MTENNKLQTIEQQLVQEKNVSDNVLNKVRVLESQGNLELPNDYSPSNAMKQAWLQISQDNKLMSCNDTSKANALLDMVTQGLNPAKNQCYFIPYGNKMQLQRSYHGNVMMLKRDAGAQDVVAQVIYKGDTFKQEMGETGRIKAIKHEQDFFNIDKENIIGAYCTIVFNDGRDNYIEVMTIEQIKQAWMQSSMIKDEKALQNSKTHNNFKEEMAKKTVINRAAKRYINTSTDSNIFKYAQESEQRQRKEVLDAEVEENANQEQLDFEQPVLEEAQYTELENDKPIDVSDFEEIKEPATEKESEEEPF

SEQ ID NO: 599 - protein, 161 aa, Unknown
  Description of Unknown: Undetermined Phage F86/06 polypeptide
MTAGTQQAMNFESHRLCTIKAKQELRIGTWSILPFDIEHDANEPVAFLLQSTLGYKVLYVTDTKYLKYKFNGITHMMLEVNYIYEQMQENIKNGSVHSTLANRIMESHFSLEHAIGMLKANDLTRLEEIHLIHLSSQNSNAKYIKSEIQKVTGVPVYVGGL

SEQ ID NO: 600 - protein, 156 aa, Unknown
  Description of Unknown: Undetermined Phage F86/06 polypeptide
MINRTILVGRLTRDPELRTTQSGVNVASFTLAVNRTFTNAQGEREADFINVIVFKKQAENVNKYLSKGSLTGVDGRLQTRNYENKEGQRVYVTEVIADSIQFLEPKNSNDTQQDLYQQQVQQTRGQSQYSNNKPVKDNPFANANGPIEIDDDDLPF

SEQ ID NO: 601 - protein, 297 aa, Unknown
  Description of Unknown: Undetermined Phage F86/06 polypeptide
MTGWISIDRSIQNHWLFKEKRTFSKFEAWIYLLMEANHSKAKVPIGNQIVTVERGQRLTSILTLSDLFNWSRFKVKTFLDLLESDGMLEVKTTSKYTLITIVNYDFYQSEQGRNQHQNDIKPTSKQHQSNINPTSKQHQTNTNNNDNKDNNEKNVNNEKKKVTAFDFFQDNGFGFITPYNLDDLNYYLDSFENDSDQIVTASLKIAKDRNKVTWGYAKSILNTWLNANLKSIEQVRAFEKQQLESKKQNYKPFVKQSKEKTPKWLTDSTRETKTPEVDENLEKDREAFIKRLNSKWE

SEQ ID NO: 602 - protein, 72 aa, Unknown
  Description of Unknown: Undetermined Phage F86/06 polypeptide
MDAFDKYYLFDHDGNKMFSVTPHFKDGRHLVVGLKHTKFNGRRWYLDDYELKTLIDNEQMELGHQTSLFEYI

SEQ ID NO: 603 - protein, 138 aa, Unknown
  Description of Unknown: Undetermined Phage F86/06 polypeptide
MRDYMEIEIKFNEVFNAPMGSPRPRFRNTGRYAHTYMPTKYTEHKKYLQNQMPKLNLENALKIELEFYFPLLKSWSKKKKNEMVGQYKVTKPDIDNLIKTVLDACNGHLWKDDNQITEITSSKRYGIEPKIIIRIEEI

SEQ ID NO: 604 - protein, 122 aa, Unknown
  Description of Unknown: Undetermined Phage F86/06 polypeptide
MARKARIVTINDKPYRFSKFEMELIESHGITAGMVSKRVKDGWELHEAMDAPEGTRLSEYREKKTIERLEQARLERKLERERKKEAELRRKKPHLFNVPQKHPRGRYACYLLENDIFVKVKK

SEQ ID NO: 605 - protein, 80 aa, Unknown
  Description of Unknown: Undetermined Phage F86/06 polypeptide
MTDNARKEYLNQFFGFKRYLYQDNERVAHIHVVNGTYYFHGHIVPGWQSVKKTFDTAEELEIYIKQHGLEYEEQKQLTLF

SEQ ID NO: 606 - protein, 57 aa, Unknown
  Description of Unknown: Undetermined Phage F86/06 polypeptide
MEMMNAEKHMQMMQMLQNCVIDKYVSHDEYEELIAIDKHGNKMFIKFYPNTEDDTNE

SEQ ID NO: 607 - protein, 83 aa, Unknown
  Description of Unknown: Undetermined Phage F86/06 polypeptide
MNNREQIEQSVISASAYNGNDTEGLLKEIEDVYKKAQAFDEILEGMTNAIQHSVKEGVELDEAVGIMAGQVVYKYEEEQENEH

SEQ ID NO: 608 - protein, 60 aa, Unknown
  Description of Unknown: Undetermined Phage F86/06 polypeptide
MSISVGDKVFNPETNSTLEIVQLVGDIRDTHYKLSDGSIISLIDFVVKPIHLIKEEQEND

SEQ ID NO: 609 - protein, 180 aa, Unknown
  Description of Unknown: Undetermined Phage F86/06 polypeptide
MTNTLQVRLLSENARMPERNHKTDAGYDIFSAETVVLEPQEKAVIKTDVAVSIPEGYVGLLTSRSGVSSKTHLVIETGKIDAGYHGNLGINIKNDEERDGIPFLYDDIDAELEDGLISILDIKGNYVQDGRGIRRIYQINKGDKLAQLVIVPIWTPELKQVEEFESVSERGAKGFGSSGV

SEQ ID NO: 610 - protein, 68 aa, Unknown
  Description of Unknown: Undetermined Phage F86/06 polypeptide
VTQYLVTTFKDSTGRKHTHITKAKSNQRFTVVEAESKEEAKEKYEKQVKRDAVIKVGQLFENIRECGK

SEQ ID NO: 611 - protein, 128 aa, Unknown
  Description of Unknown: Undetermined Phage F86/06 polypeptide
MIKKLKNMDGFDIFIVGILSLFGITALLLVVALPIYTVASYQNKEVHQGTITDKYNKRQDKEDKFYIVLDDKQVIENSDLFFKGKFDSADIQARLKVGDKVKVKTIGYRIHFLNLYPVLYEVKKVDKK

SEQ ID NO: 612 - protein, 49 aa, Unknown
  Description of Unknown: Undetermined Phage F86/06 polypeptide
MIKQILRLLFLLAMYELGKYVTEQVYIMMTANDDVEAPSDYVFRAEVSE

SEQ ID NO: 613 - protein, 66 aa, Unknown
  Description of Unknown: Undetermined Phage F86/06 polypeptide
MWITMTIVFAILLLVCISINSDRAREIQALRYMNDYLLDEVVKTKGYNGLKEYRIELKRMNNDIKK

SEQ ID NO: 614 - protein, 178 aa, Unknown
  Description of Unknown: Undetermined Phage F86/06 polypeptide
MYNRKEIREMIDNYKWMKNIIDSKVYDNESTSIAQYGYQSAMPKAKGTTSNKVLVKVINKNKALRKYDYLINKIAFIDEYEEYITNEKDYHILQMLKQRESHNRIMSILDIGRDNFYSRVKDIVNILYNLQTRNRHIVHIGQFGHIVQIVQIVHIGLILMLHIVFYYNCYVAKHLYLF

SEQ ID NO: 615 - protein, 150 aa, Unknown
  Description of Unknown: Undetermined Phage F86/06 polypeptide
MEISKYQEIATRTHNDELNLNESITCYGLGLTQSTGNVTDLIKQHMFCNVPIDKGIMINELSEALWNIANLTNVLGINLDEIAGHSVNTILMNKPNQTINLDNGIKQGDKVLFQGSKYLVDGSIGNLLLISNDKDDRQVTVQDVKKVDKE

SEQ ID NO: 616 - protein, 117 aa, Unknown
  Description of Unknown: Undetermined Phage F86/06 polypeptide
LSIMKRCGHPTCNVLINHNESYCDKHKQYANENYNDLRRRNDPEYLRFYKSKTWQNMRRIVLLEHDFICVSCGNQATMVDHIVPTKIDWARRLDKSNLQPLCDACHNQKTKEDLKKY

SEQ ID NO: 617 - protein, 114 aa, Unknown
  Description of Unknown: Undetermined Phage F87s/06 polypeptide
MEIIVDENLVLKEKERLQVLYKDIPSNKLKVVDGLIIQAARLRVMLDYMWEDIKEKGDYDLFTQSEKAPPYERERPVAKLFNARDAAYQKIIKQLSDLLPEEKEDTETPSDDYL

SEQ ID NO: 618 - protein, 553 aa, Unknown
  Description of Unknown: Undetermined Phage F87s/06 polypeptide
MISNKYVDEYINLWKQGKIILNKERIDLFNYLQKHIYSRDDVYFDEQKIEDCIKFIEKWYFPTLPFQRFIIANIFLIDKNTDEAFFTEFAIFMGRGGGKNGLISAISDFLSTPLHGVKEYHISIVANSEDQAKTSFDEIRTVLMDNKRNKTGKTPKAPYEVSKAKIINRATKSVIRYNTSNTKTKDGGREGCVIFDEIHYFFGPEMVNVKRGGLGKKKNRRTFYISTDGFVREGYIDAMKHKIASVLSGKVKNSRLFAFYCKLDDPKEVDDRQTWEKANPMLHKPLSEYAKTLLSTIEEEYNDLPFNRSNKPEFMTKRMNLPEVDLEKVIAPWKEILATNREIPNLDNQMCIGGLDFANIRDFASVGLLFRKNDDYIWLGHSFVRQGFLDDVKLEPPIKEWEKMGLLTIVDDDVIEIEYIVDWFLKAREKYGLEKVIADNYRTDIVRRAFEDAGIKLEVLRNPKAIHGLLAPRIDTMFAKHNVIYGDNPLMRWFTNNVAVKIKPDGNKEYIKKDEVRRKTDGFMAFVHALYRADDIVDKDMSKALDALMSIDF

SEQ ID NO: 619 - protein, 387 aa, Unknown
  Description of Unknown: Undetermined Phage F87s/06 polypeptide
MSILEKIFKTRKDISYMLDLDMIEDLSQQAYVKRLAIDSCIEFVARAVAQSHFKVLEGNRIQKNDVYYKLNIKPNTDLSSDSFWQQVIYKLIYDNEVLIVVSDSKELLIADSFYREEYALYDDIFKDVTVKDYTYQRTFTMQEVIYLKYNNNKVTHFVESLFEDYGKIFGRMIGAQLKNYQIRGILKSASSAYDEKNIEKLQAFTNKLFNTFNKNQLAIAPLIEGFDYEELSNGGKNSNMPFSELSELMRDAIKNVALMIGIPPGLIYGETADLEKNTLVFEKFCLTPLLKKIQNELNAKLITQSMYLKDTRIEIVGVNKKDPLQYAEAIDKLVSSGSFTRNEVRIMLGEEPSDNPELDEYLVTKNYEKANENGSTLKGGDEDESGD

SEQ ID NO: 620 - protein, 245 aa, Unknown
  Description of Unknown: Undetermined Phage F87s/06 polypeptide
MKVEIKGVIVSNEDKWVYEMLGMDSTCPKDVLTQLEFSDEDVDIIINSNGGNLVAGSEIYTHLRAHKGKVNVRITAIAASAASLIAMAGDHIEMSPVARMMIHNPSSIAQGEAKDLNHAAETLEHVGQIMAEAYAVRAGKNKQELIEMMAKETWLNADEAIEQGFADSKMFENDNMQIVASDTQVLSKDVLNRVTALVSKTPEVNIDIDAIANKVIEKINMKEKESEIDVADSKLSANGFSRFLF

SEQ ID NO: 621 - protein, 381 aa, Unknown
  Description of Unknown: Undetermined Phage F87s/06 polypeptide
MTINLSETFANAKNEFINAVNNGEPQERQNELYGDMINQLFEETKLQAKAEAERVSSLPKSAQTLSANQRNFFMDINKSVGYKEEKLLPEETIDRIFEDLTTNHPLLADLGIKNAGLRLKFLKSETSGVAVWGKIYGEIKGQLDAAFSEETAIQNKLTAFVVLPKDLNDFGPAWIERFVRVQIEEAFAVALETAFLKGTGKDQPIGLNRQVQKGVSVTDGAYPEKEEQGTLTFANPRATVNELTQVFKYHSTNEKGKSVAVKGNVTMVVNPSDAFEVQAQYTHLNANGVYVTALPFNLNVIESTVQEAGKVLTYVKGLYDGYLAGGINVQKFKETLALDDMDLYTAKQFAYGKAKDNKVAAVWKLDLKGHKPALEDTEETL

SEQ ID NO: 622 - protein, 94 aa, Unknown
  Description of Unknown: Undetermined Phage F87s/06 polypeptide
MVKFKVVREFKDIEHNQHKYKVGELYPAEGYNNPRVELLTNQIKNKYDKVYIVPLDKLTKQELLELCESLQKKASSSMVKSEIIDLLNGEDNDD

SEQ ID NO: 623 - protein, 94 aa, Unknown
  Description of Unknown: Undetermined Phage F87s/06 polypeptide
MTIDDLLVKFKSLEKIDHNSEDEYLKQLLKMSYERIKNQCGVFELENLIGQELILIRARYAYQDLLEHFNDNYRPEIIDFSLSLMEVSEDEESV

SEQ ID NO: 624 - protein, 120 aa, Unknown
  Description of Unknown: Undetermined Phage F87s/06 polypeptide
MKKVFKKPRITTKRLNTRVHFYKYTENNGPEAGEKEEKLLYSCWASIDGVWLRELEQAISNGTQNDIKLYIRDPQGDYLPSEEHYLEIESRYFKNRLNIKQVSPDLDNKDFIMIRGGYSS

SEQ ID NO: 625 - protein, 135 aa, Unknown
  Description of Unknown: Undetermined Phage F87s/06 polypeptide
MSVKVTGDKALERELEKHFGIKEMVKVQDKALIAGAKVIVEEIKKQLKPSEDSGALISEIGRTEPEWIKGKRTVTIRWRGPFERFRIVHLIENGHVEKKSGKFVKPKAMGGINRAIRQGQNKYFETLKRELKNCD

SEQ ID NO: 626 - protein, 138 aa, Unknown
  Description of Unknown: Undetermined Phage F87s/06 polypeptide
VIDILYKVHEVISQDRIIREHVNINNIKFNKYPNVKDTDVPFIVIDDIDDPIPTTYTDGDECAYSYIVQIDVFVKYNDEYNARIIRNKISNRIQKLLWSELKMGNVSNGKPEYIEEFKTYRSSRVYEGIFYKEEIKWQ

SEQ ID NO: 627 - protein, 109 aa, Unknown
  Description of Unknown: Undetermined Phage F87s/06 polypeptide
MAIKHASAPKAYFNITGLGFAKLTKEGAELKYSDITKTRGLQKIVLNWWRTKNKLMLMVVQSNQGTQTEKVKFRYKCMLSLKRFAKLFLMKIMMKMAFTKRNKVNKTIT

SEQ ID NO: 628 - protein, 138 aa, Unknown
  Description of Unknown: Undetermined Phage F87s/06 polypeptide
MHAFPKEIRKIVFNEDYDEDGVYEEKQGKQNNYVAVWFRQERRDGTFRTVLLPKVMFTNPKIDGETAEKDWDFSSEEVEGEALFPLVDNKKSVRKYIFDSANMTNHDGDGEKGEEAFLKKILGEEYTGNVTEGNEETL

SEQ ID NO: 629 - protein, 46 aa, Unknown
  Description of Unknown: Undetermined Phage F87s/06 polypeptide
LKYTTDQTNIVSINSDGQVTAEAQGIATVKATVGNMSDTITINVEA

SEQ ID NO: 630 - protein, 116 aa, Unknown
  Description of Unknown: Undetermined Phage F87s/06 polypeptide
MAKLKRNIIQLVEDPKANEIKLQTYLTPHFISFEIVYEAMDLIDDIEDENSTMKPREIADRLMDMVVKIYDNQFTVKDLKERMHAPDGMNALREQVIFITQGQQTEETRNFIQNMK

SEQ ID NO: 631 - protein, 53 aa, Unknown
  Description of Unknown: Undetermined Phage F87s/06 polypeptide
MLKNMDTLMMDLIENGKDANEVLKMPFHYVLSIYQNKNNDISEEKAEALIDAF

SEQ ID NO: 632 - protein, 1514 aa, Unknown
  Description of Unknown: Undetermined Phage F87s/06 polypeptide
MGERIKGLSIGLDLDAANLNRSFAEIKRNFKTLNSDLKLTGNNFKYTEKSTHSYKQRIKELDGTITGYKKNVDDLAKQYGKVSQEQGENSAEAQKLRQEYNKQANELNFLEKELEKTTTEFEEFKKAQVEAQRMAESGWGKTSKVFESMGPKLTKMGDGLKSIGKGLMIGVTAPVLGIAAASGKAFAEVDKGLDTVTQATGATGGELKKLQNSFKDVYGNFPADAETVGGVLGEVNTRLGFTGKELESATESFLKFSHITGSEGVQAVQLITRAMGDAGIEADEYQSVLDMVAKAAQASGISVDTLADSITKYGAPMRAMGFEMKESIALFSQWEKSGVNTEIAFSGLKKAISNWGKAGKNPREEFKKTLAEIEKTPDIASATSLAIEAFGAKAGPDLADAIKGGRFSYQEFLKTIEDSQGTVNQTFKDSESGSERFKVAMNKLKLVGADVWTSIESAFAPVMEELIKKLSIAVDWFSNLSDGSKRSIVIFGGIAAAIGPVVFGLGAFISTIGNAVTVLAPLLAGIAKADGLISFLSTKVPILGTVFTALTGPIGIVLGVLAGLAVAFTIAYKKSETFRNFVNGAINSVKQTFSNFIQFIQPFIDSVKNVFKQAVSAIVDFAKDIWSQINGFFNENGISIVQALQNICNFIKAIFEFILNFVIKPIMFAIWQVMQFIWPAVKALIVSTWENIKGVIQGALNIILGFIKFFSSLFTGNWRGVWDGIVMILKGTVQLIWNLIQLWFVGKILGVVRYFGGLLKGLISGIWGVIKGIFTKSLSAIWNATKSIFGFLYNSVKSIFTNMKNWLSSTWNNIKSNTVGKAHSLFTGVRSKFTSLWNATKDIFTKLRNWMSNIWNSIKDNTVGIAGRLWDRVRNIFGSMRDGLKSIISKIKDHIGGMVDAVKRGLNKLIEGLNWVGGKLGMDKIPKLHTGTEHTHTTTRLVKNGKIARDTFATVGDKGRGNGPNGFRNEMIEFPNGKRVITPNTDTTAYLPKGSKVYNGAQTYSMLNGTLPRFHFGTTMWKDIKSSASSAFNWTKDQIGKGTKWLGDKVGDVMDFIDNPGKLLNYVLKAFGVDFSSLTKGMGIVGDITKASWNKIKSKAINWIKEGLESQAGDGSVFDSFRILQPYSAPPKPPNPNYPFNGGVHHGVDYDTPTGTPIRTPMGGRVRSWYDNYGGGKAITVQKGRTFLWFMHLSEQLRRTGEQIKAGQLIGKSGNTGSMTNYRHLHFQVNQGGESNRYSTDPIPWLRKNDKTGGKNSPGGSGSENARRAIRTAQNILGGQYKASWITHEMMRVARRESNYTANAVNNWDSNARAGTPSRGMFQMIDPSFRAYAKSGYNNPLNPTHQAISAMRYIVGKWVPRTGSWRAAFKRAGDYAYATGGKVYNGLYHLGEEGYPEWVIPTDPARKNEAMKMLHYAAAEVRGRKASKNKRPSQLSSVNGFDDPSLLLKMIEQQQQQIALLLKIAQSNDVIADKDYQPIIDEYAFDKKVNASIEKRERQESTKVKFRKGGIAIQ

SEQ ID NO: 633 - protein, 394 aa, Unknown
  Description of Unknown: Undetermined Phage F87s/06 polypeptide
VVRNDYLSHNGFKTHDDVLNELVKFFNYEEQVKLQFKSKDWYWNAYFEGPIKLHKEFAIPVKFTIKVVLTDPYKYSVTGYKNTAISDQVSVVNSGTADTPLIVEARAIKPSSYFMITKNDEDYFMVGDDEVTKEVKDYMPPVYHSEFRDFKGWTKMITEDIPSNDLGGKVGGDFVISNLGEGYKATNFPDAKGWVGAGTKRGLPKAMTDFQITYKCIVEQKGKGAGRTAQHIYDSDGKLLASIGYENKYHDRKIGHIVVTLYNQKGDPKKIYDYQNKPIMYNLDRIVVYMRLRRVGNKFSIKTWKFDHIKDPDRRKPIDMDEKEWIDGGKFYQRPASIIAIYSAKYNGYKWMEMNGLGSFNTEILPKPKGARDVIIQKGDLVKIDMQAKSSCHQ

SEQ ID NO: 634 - protein, 363 aa, Unknown
  Description of Unknown: Undetermined Phage F87s/06 polypeptide
VIHVLDFNDKIIDFLSTDDPSLVRAIHKRNVNDNSEMLELLISSERAEKFRERHRVIIRDSNKQWREFIINWVQDTMDGYTEIECIASYLADITTAKPYAPGKFEKKTTSEALKDVLSDTGWEVSEQTEYDGLRTTSWTSYQTRYEVLKQLCTTYKMVLDFYIELSSNTVKGRYVVLKKKNSLFKGKEIEYGKDLVGLTRKIDMSEIKTALIAVGPENDKGKRLELVVTDDEAQSQFNLPTRYIWGIYEPQSDDQNMNETRLRSLAKTELNKRKSAVMSYEITSTDLEVTYPHEIISIGDTVRVKHRDFNPPLYVEAEVIAEEYNIISENSTYTFGQPKEFKESELREEFNKRLNIIHTKVKR

SEQ ID NO: 635 - protein, 861 aa, Unknown
  Description of Unknown: Undetermined Phage F87s/06 polypeptide
MLWYDTSNPDVAVLRRYWNGRWIEATPNDVEKLGGITREKALFSELNNIFINLSIQHASLLSEATELLNSEYLVDNDLKEDLQASLDAVIDVYNQIKNNLESMTPETATIGRLVDTQALFLEYRKKLQDVYTDVEDVKMAISDRFKLLQSQYTDEKYKEALEIIATKFGLTVNEDLQLVGEPNVVKSAIEAARESTKEQLRDYVKTSDYKTDKDGIVERLDTAEAERTTLKGEIKDKVTLNEYRNGLEEQKQYTDDQLSDLSNNPEIKASIEQANQEAQEALKSYIDAQDDLKEKESQAYADGKISEEEQRAIQDAQAKLEEAKQNAELKARNAEKKANAYTDNKVKESTDAQRKTLTRYGSQIIQNGKEIKLRTTKEEFNATNRTLSNILNEIVQNVTDGTTIRYDDNGVAQALNVGPRGIRLNADKIDINGNREINLLIQNMRDKVDKTDIVNSLNLSREGLDINVNRIGIKGGDNNRYVQIQNDSIELGGIVQRTWRGKRSTDDIFTRLKDGHLRFRNNTAGGSLYMSHFGISTYIDGEGEDGGSSGTIQWWDKTYSDSGMNGITINSYGGVVALTSDNNRVVLESYASSNIKSKQAPVYLYPNTDKVPGLNRFAFTLSNADNAYSSDGYIMFGSDENYDYGAGIRFSKERNKGLVQIVNGRYATGGDTTIEAGYGKFNMLKRRDGNRYIHIQSTDLLSVGSDDAGDRIASNSIYRRTYSAAANLHITSAGTIGRSTSARKYKLSIENQYNDRDEQLEHSKAILNLPIRTWFDKAESEILARELREDRKLSEDTYKLDRYVGLIAEEVENLGLKEFVTYDDKGEIEGIAYDRLWIHLIPVIKEQQLRIKKLEESKNAG

SEQ ID NO: 636 - protein, 50 aa, Unknown
  Description of Unknown: Undetermined Phage F87s/06 polypeptide
MQDNKQGLQANPEYTIHYLSQEIMRLTQENAMLKAYIQENKENQQCAEEE

SEQ ID NO: 637 - protein, 73 aa, Unknown
  Description of Unknown: Undetermined Phage F87s/06 polypeptide
MAKEIINNTERFILVQIDKEGTERVVYQDFTGSFTTSEMVNHAQDFKSEENAKKIAETLNLLYQLTNKKQRVK

SEQ ID NO: 638 - protein, 98 aa, Unknown
  Description of Unknown: Undetermined Phage F87s/06 polypeptide
LGWFKKHEHEWRIRRLEENDKTMLSTLNEIKLGQKTQEQVNIKLDKTLDAIQKEREIDEKNKKENDKNIRDMKMWVLGLVGTIFGSLIIALLRMLMGI

SEQ ID NO: 639 - protein, 44 aa, Unknown
  Description of Unknown: Undetermined Phage F87s/06 polypeptide
MVALLKSLERRRLMITISTMLQFGLFLIALIGLVIKLIELSNKK

SEQ ID NO: 640 - protein, 84 aa, Unknown; identical to SEQ ID NO: 574
  Description of Unknown: Undetermined Phage F87s/06 polypeptide

SEQ ID NO: 641 - protein, 251 aa, Unknown
  Description of Unknown: Undetermined Phage F87s/06 polypeptide
MKTYSEARARLRWYQGRYIDFDGWYGYQCADLAVDYIYWLLEIRMWGNAKDAINNDFKNMATVYENTPSFVPQIGDVAVFTKGIYKQYGHIGLVFNGGNTNQFLILEQNYDGNANTPAKLRWDNYYGCTHFIRPKYKSEGLMNKITNKVKPPAQKAVGKSASKITVGSKAPYNLKWSKGAYFNAKIDGLGATSATRYGDNRTNYRFDVGQAVYAPGTLIYVFEIIDGWCRIYWNNHNEWIWHERLIVKEVF

SEQ ID NO: 642 - protein, 163 aa, Unknown
  Description of Unknown: Undetermined Phage F87s/06 polypeptide
MLKRGLLFLTVLLLLFSFSSITNEVSASSSFDKGKYKKGDDASYFEPTGPYLMVNVTGVDGKGNELLSPHYVEFPIKPGTTLTKEKIEYYVEWALDATAYKEFRVVELDPSAKIEVTYYDKNKKKEETKSFPITEKGFVVPDLSEHIKNPGFNLITKVVIEKK

SEQ ID NO: 643 - protein, 98 aa, Unknown
  Description of Unknown: Undetermined Phage F87s/06 polypeptide
VPAGYTLDKNNVPYKKETGYYTVANVKGNNVRDGYSTNSRITGVLPNNATIKYDGAYCINGYRWITYIANNGQRCYIATGEVDKAGNRISSFGNFSAL

SEQ ID NO: 644 - protein, 116 aa, Unknown
  Description of Unknown: Undetermined Phage F87s/06 polypeptide
MKIRKSILAGTLAIVLASPLVTNLDKNEAQASTSLPTSNEYQNEKLANELKSLLDELNVNELATGSLNTYYKRTIKISGQKAMYALKSKDFKKMSEAKYQLQKIYNEIDEALKSKY

SEQ ID NO: 645 - protein, 346 aa, Unknown
  Description of Unknown: Undetermined Phage F87s/06 polypeptide
MKTRCYDGKKWQYEFKYEGKRYRKKGFRTKREANSAGLDKLNELRSGFNIDNYITLEEYFENWIKTYKQPVVKENTYRHYRNALQHIQKHKIGKMELSKINRQVYQKFINDYSKEHAKETIRKTNGAIRSALDDALYDGLIFKNPAYKVNYKAGKPTKSEQEKFISVTEYEILKDHVRKKRTRSSLALFIMICTGCRVSGARNIKIEHINQVKNTIFIDERKTDTSPRYISIAKSDMKHIMDVISTFAISYDGYIFKEAGSIINLHAINNALKSACRVNNIPIITSHALRHTHCSYLLAKGVSIHYISKRLGHKNIAITTSVYSHLLEEKFNEEDKKQLKFRKYVI

SEQ ID NO: 646 - protein, 251 aa, Unknown
  Description of Unknown: Undetermined Phage F87s/06 polypeptide
LNGGESVSENKGEMMTHNIEKRINKLKTSGNPKFKKLDSDIHYLLKRFEGEKNHKGFYPKFKQGEIVFVDFGINVNKEFSNSHFAIVMNKNDSNTEDIVNVIPLSSKENKKYLKMNFDLKWEYYLRLFLNLISAQNNSAILKEVFDKKYQKNNTEFITKDYFSEFISDSLEIENKLNKIDRNINNIVSAIDKVKKLKGNSYACINSFQPISKFRIRKVLPQKIKNPVIDSSDIMLLINRINNNILQIPDIR

SEQ ID NO: 647 - protein, 60 aa, Unknown
  Description of Unknown: Undetermined Phage F87s/06 polypeptide
MKITNCKIKKETIVYEVLTSGNQPFTYELPKDLSSHNARKYLEFISQKIDGDKLTKEDSL

SEQ ID NO: 648 - protein, 61 aa, Unknown
  Description of Unknown: Undetermined Phage F87s/06 polypeptide
MSTYKEIEHLHINTGGKELTQEQIEEAKAFIDSQEFKDMIREAKESHQRVMESKITDRTKL

SEQ ID NO: 649 - protein, 48 aa, Unknown
  Description of Unknown: Undetermined Phage F87s/06 polypeptide
MDFKEVDINIEEWEMVEIPFYTEEELTYRLNNGLPITKSELEEQESKK

SEQ ID NO: 650 - protein, 284 aa, Unknown
  Description of Unknown: Undetermined Phage F87s/06 polypeptide
MKPRKQDEKILSDQYSYFEPIISDSCDIKFDENKRRMGSIFISHEEICFIRKEEDYIFKISLSEVIDYNTVVTIWKNQAFLTLNDNRKLTVYFVTNSPLTGFISILKTYMQLSKNKETIISNDCLPINDDEQTKVEIFDVVGLNYEGRRKELKKLIKKMKNNDDFFFLYSDLKGNELKEELLYEDKVYEISDYEVIPGVFLQKEPDNPYDENAIKVMISNEYSEFHVGYVPREYASRLVNHMDNIVSCNAYINGGKYKTLDYLEEKIVTKESDYGLRVHLEYKV

SEQ ID NO: 651 - protein, 238 aa, Unknown
  Description of Unknown: Undetermined Phage F87s/06 polypeptide
MNSFKDRLKQIMSERKISQSELSRRTGIGRNSISDYLNGKYEAKQDKVFELAKALNVNEAWLMGFDISKNRKIENNDITSIYSKLTPPRQSNVLKYATNQLEEQNNDSDNLVDFNSYIQEKSEVDIYGCASAGIGERLYNEPISKEFVRGYVPAHDIALKVNGDSMEPLFKNGQIIFIEKSHTIKDGQIGVFIINGDAYVKKVYVEDNRLTLVSLNKKYKDLYFYDNESVRLVGKVIL

SEQ ID NO: 652 - protein, 80 aa, Unknown
  Description of Unknown: Undetermined Phage F87s/06 polypeptide
MIYNFDYSLLYERMAEYRYSQSSLANAIPISRTSINHKLQGKNLFTQWEIKRICELLEIPPTKVGRYFFEQNVQKPVQMS

SEQ ID NO: 653 - protein, 42 aa, Unknown
  Description of Unknown: Undetermined Phage F87s/06 polypeptide
MEQITLTKEELKEIIAKEVREAINGKKPISSGSNFQQSKNQP

SEQ ID NO: 654 - protein, 125 aa, Unknown
  Description of Unknown: Undetermined Phage F87s/06 polypeptide
MARNQSVQVLIFNKVRISHNDFDEINKKFAYTERLRGADNLGLGHPLSLKKYQHGIGCYENYKAYASEIHDHIRKLTLSAFGVTLNSDLKESEYDEASRMYDMLKNFYLYRYQKRIETLSIEDFE

SEQ ID NO: 655 - protein, 46 aa, Unknown
  Description of Unknown: Undetermined Phage F87s/06 polypeptide
MLQKFRIAKEKNKLKLKLLKHASYCLERNNNPELLRAVAELLKKVS

SEQ ID NO: 656 - protein, 69 aa, Unknown
  Description of Unknown: Undetermined Phage F87s/06 polypeptide
MKLLVTLKDGSKKHVSDLKKIVFPGYEGIETVTKEEIETFFLDPTKTYVFVGSQTLSVEAGQILTVEFS

SEQ ID NO: 657 - protein, 249 aa, Unknown
  Description of Unknown: Undetermined Phage F87s/06 polypeptide
MQALQTKSNIGEMFNIQEKENGEIAISARELYKALEVKKRFSAWAEINLKHFKENRDFTSVLTSTVVNNGAVRQLEDYALTLDVAKHVAMMSGTEKGFDFREYFIQVEKAWNSPEMIMQRALKIANNTINQLETKIERDKPKIVFADAVATTKTSILVGELAKIIKQNGVNIGQRRLFEWLRQNGFLIKRKGVDYNMPTQYSMERELFEIKETSITHSDGHTSISKTPKVTGKGQQYFVNKFLGEKQTS

SEQ ID NO: 658 - protein, 86 aa, Unknown
  Description of Unknown: Undetermined Phage F87s/06 polypeptide
MEQITLTKEECVEQCINKDLKLLDYRVQQILEGVLSESTTYGDARNKLETLKIIAESHFKTEHASVIYKLALKKLDKKINATPIKE

SEQ ID NO: 659 - protein, 45 aa, Unknown
  Description of Unknown: Undetermined Phage F87s/06 polypeptide
MFKILNDIKTSLKNHPWGWKEHLPYLLMLTLSLVALIFGVLSAIL

SEQ ID NO: 660 - protein, 109 aa, Unknown
  Description of Unknown: Undetermined Phage F87s/06 polypeptide
MIEMPHVLNVTVPIPETHVLITKDEYEELIAYSLDPVWNMSDLKKKLKIASDETIKDRLLFHPRFEKELRAQGIVHYPDENFNRWRFNARKMNKFVDEHFNEIYKERIK

SEQ ID NO: 661 - protein, 53 aa, Unknown
  Description of Unknown: Undetermined Phage F87s/06 polypeptide
MSKTYKSYLLAVLCFTVLAIVLMPFLYFTTAWSIAGFASIATFIFYKEYFYEE

SEQ ID NO: 662 - protein, 86 aa, Unknown
  Description of Unknown: Undetermined Phage F87s/06 polypeptide
MYYKIGDVCQKVINVDGFDFKLAVKKQDYSILVNVLDLEDRFIDSINITDENDLYTALDILNQSIYEWIEENTDERDRLINLVMRW

SEQ ID NO: 663 - protein, 92 aa, Unknown
  Description of Unknown: Undetermined Phage F87s/06 polypeptide
MVGISMRDTERNILNIFKTLFDEYTLSNQRALLEIERNHHGYLSINFLHYHDSYKTNNKLVQIHEINPDSHERIKNLIIEVLRGHRKIKKGA

SEQ ID NO: 664 - protein, 649 aa, Unknown
  Description of Unknown: Undetermined Phage F87s/06 polypeptide
MEIKINKLTISNFAGIKEESFNFNGKDAKIYGNNATGKTTTATALQWLLFDKGLDGSTKSFNPVPLNEKNEENYELIPTVFAEFEIDGKITTFKKESHPKYTINQKTNRKEYSRSRTKKQYINDESIKVKDYKARIDELIDEDVFKLITNPQAFNLLDWKKRRSLLFEIAKPINDEDVIKTNDDFKELNNILGDHEIETKKKILTDKIKQINKDIKDIPIRINQTQQNKQDVPEFDNDRYAIIKQEIEQLENERIDIQNGKEEINLRNQLADKQSELKRIEDNNSASNENKIHALTNELHVENGTVANLKTRLKQNKQQITHEENRRNQLLENHKGLKSDLEKAKNQKFEYLDDNVCSCCGQQLPAEQVSEVREKALQKFNANKSKELETIQTSINHIISEGKKIKPIIEKLEDDNNNLQIKINEAEERSARIQNKINKLKTTHVDVTQTDEYKAVMLEINEINQKRSNIRKTIQDKVSGIDDKISELTQEKSEIEVSISIEKSNKHLDDVISELRNEEDRLLDEKEKYSHDLYILKEFTTTKVKMLTENINNEFDIAEFKLFNTLVNGELEETCSTTVNGVEYDSGLNNASRINVGLDIINTLSKHFKVTAPIFIDNAESVTELIKTESQQIQLIVNEQDKKLRMETI

SEQ ID NO: 665 - protein, 306 aa, Unknown
  Description of Unknown: Undetermined Phage F87s/06 polypeptide
MTENNKLQTIEQQLVQEKNVSDNVLNKVRVLESQGNLELPNDYSPSNAMKQAWLQISQDNKLMSCNDTSKANALLDMVTQGLNPAKNQCYFIPYGNKMQLQRSYHGNVMMLKRDAGAQDVVAQVIYKGDTFKQEMGETGRIKAIKHEQDFFNIDKENIIGAYCTIVFNDGRDNYIEVMTIEQIKQAWMQSSMIKDEKALQNSKTHNNFKEEMAKKTVINRAAKRYINTSTDSNLFKYAQESEQRQRKEVLDAEVEENANQEQLDFEQPVLEEAQYTELENDKPIDVSDFEEIKEPATEKESEEEPF

SEQ ID NO: 666 - protein, 117 aa, Unknown
  Description of Unknown: Undetermined Phage F87s/06 polypeptide
VAFLLQSTLGYKVLYVTDTKYLKYKFNGITHMMLEVNYIYEQMQENIKNGSVHSTLANRIMESHFSLEHAIGMLKANDLTRLEEIHLIHLSSQNSNAKYIKSEIQKVTGAPVYFGGL

SEQ ID NO: 667 - protein, 156 aa, Unknown
  Description of Unknown: Undetermined Phage F87s/06 polypeptide
MLNRTILVGRLTRDPELRTTQSGVNVASFTLAVNRTFTNAQGEREADFINIIVFKKQAENVNKYLSKGSLAGVDGRLQTRNYENKEGQRVYVTEVIADSIQFLEPKNSNDTQQDLYQQQVQQTRGQSQYSNNKPVKDNPFANANGPIELNDDDLPF

SEQ ID NO: 668 - protein, 297 aa, Unknown
  Description of Unknown: Undetermined Phage F87s/06 polypeptide
MTGWISIDRSIQNHWLFKEKRTFSKFEAWIYLLMEANHSEAKVPIGNQIVTVERGQRLTSILTLSDLFNWSRFKVKTFLDLLESDGMLEVKTTSKYTLITIVNYDFYQSEQGRNQHQNDIKPTSKQHQSNINPTSKQHQTNTNNNDNKDNNEKNVNNEKKKVTAFDFFQDNGFGFITPYNLDDLNYYLDSFENDSDEIVTASLKIAKDRNKVTWGYAKSILNTWLNANLKSIEQVRAFEKQQLESKKQNYKPFVKQSKEKTPKWLTDSTRETKTPEVDENLEKDREAFIKRLNSKWE

SEQ ID NO: 669 - protein, 72 aa, Unknown; identical to SEQ ID NO: 602
  Description of Unknown: Undetermined Phage F87s/06 polypeptide

SEQ ID NO: 670 - protein, 102 aa, Unknown
  Description of Unknown: Undetermined Phage F87s/06 polypeptide
MPTKYTEHKKYLQNQMPKLNLENALKIELEFYFTPPKSWSKKKKTQAIGQLKVTKPDIDNLMKTVLDACNNYLWKDDNQIAEITSSKRYGIEPKIIIRIEEI

SEQ ID NO: 671 - protein, 122 aa, Unknown
  Description of Unknown: Undetermined Phage F87s/06 polypeptide
MARKARIVTINDKPYRFTKSEMELIESHGITAGMVSKRVKDGWELHEAMDAPEGTRLSEYREKKTIERLEQARLERKLERKRKKEAELRRKKPHLFNVPQKHPRGRYACYLMENDIFVKVKK

SEQ ID NO: 672 - protein, 80 aa, Unknown
  Description of Unknown: Undetermined Phage F87s/06 polypeptide
MTDNARKEYLNQFFGSKRYLYQDNERVAHIHVANGNYYFHGHIVPGWQGVKKTFDTAEELEIYIKQHGLEYEKQKQLTLF

SEQ ID NO: 673 - protein, 33 aa, Unknown
  Description of Unknown: Undetermined Phage F87s/06 polypeptide
MQDALKEDIGLDEAVGIMTGQVVYKYEEAQENE

SEQ ID NO: 674 - protein, 178 aa, Unknown
  Description of Unknown: Undetermined Phage F87s/06 polypeptide
MNNTLTIDQLQELLQIQKEFDDRIPTLNLRDSKIAYVVEFFEWFNTLETFKNWKKKPGKPLDVQLDELADMLAFGLSIANQVGVSSEEIKEAIESSFKDTEFHKMFNFKDKEFAQDAVVSTPQIIFKEFYPDQQAIVIVIDIAYNLYSIDQLIDAYKKKMKRNHERQDGTADAGKGYV

SEQ ID NO: 675 - protein, 81 aa, Unknown
  Description of Unknown: Undetermined Phage F87s/06 polypeptide
VSDMLEIFLIGFGVYLFYRIAIIFLKSKKTIHTNIYEMLMLATIFMISTFAYKHQKTHILIAFLVMFFMSKLKQVQGSYEE

SEQ ID NO: 676 - protein, 68 aa, Unknown
  Description of Unknown: Undetermined Phage F87s/06 polypeptide
MTQYLVTTFKDSTGRKHTHITKAKSNQRFTVVEAESKEEAKEKYEKQVKRDAVIKVGQLFENIRECGK

SEQ ID NO: 677 - protein, 128 aa, Unknown; identical to SEQ ID NO: 611
  Description of Unknown: Undetermined Phage F87s/06 polypeptide

SEQ ID NO: 678 - protein, 49 aa, Unknown; identical to SEQ ID NO: 612
  Description of Unknown: Undetermined Phage F87s/06 polypeptide

SEQ ID NO: 679 - protein, 66 aa, Unknown; identical to SEQ ID NO: 613
  Description of Unknown: Undetermined Phage F87s/06 polypeptide

SEQ ID NO: 680 - protein, 138 aa, Unknown
  Description of Unknown: Undetermined Phage F87s/06 polypeptide
MIKIEKHDIKKLEEYIQHIDNYRRELKMREYELLESHEPDNAGAGKSNLPGNPIERCAIKKFSDNRYNTLRNIVNGVDRLIDESDEDTLELLRFRYWDCPIGCYEWEDIAHYFGTSKTSILRRRNALIDKLAKYIGYV

SEQ ID NO: 681 - protein, 99 aa, Unknown
  Description of Unknown: Undetermined Phage F87s/06 polypeptide
MMTKDERIRFYKSKEWQTTRKRVLERDNYECQQCKRDGKLTTYDKSKRKSLDVDHILSLEHHPEFAHDLNNLETLCIKCHNKKEKRFIKKENKWKDEKW

SEQ ID NO: 682 - protein, 126 aa, Unknown
  Description of Unknown: Undetermined Phage F91a/06 polypeptide
PPSYNHFKAGDEMEIIVDENLVLKEKERLQVLYKDIPSNKLKVVDGLIIQAARLRVMLDYMWEDIKEKGDYDLFTQSEKAPPYERERPVAKLFNARDAAYQKIIKQLSDLLPEEKEDTETPSDDYL

SEQ ID NO: 683 - protein, 528 aa, Unknown
  Description of Unknown: Undetermined Phage F91a/06 polypeptide
LISLIIYKQHIYSRDDVYFDEQKIEDCIKFIEKWYFPTLPFQRFIIANIFLIDKNTDEAFFTEFAIFMGRGGGKNGLISAISDFLSTPLHGVKEYHISIVANSEDQAKTSFDEIRTVLMDNKRNKTGKTPKAPYEVSKTEIINRATKSVIRYNTSNTKTKDGGREGCVIFDEIHYFFGPEMVNVKRGGLGKKKNRRTFYISTDGFVREGYIDAMKHKIASVLSGKVKNSRLFAFYCKLDDPKEVDDRQTWEKANPMLHKPLSEYAKTLLSTIEEEYNDLPFNRSNKPEFMTKRMNLPEVDLEKVIAPWKEILATNREIPNLDNQMCIGGLDFANIRDFASVGLLFRKNDDYIWLGHSFVRQGFLDDVKLEPPIKEWEKMGLLTIVDDDVIEIEYIVDWFLKAREKYGLEKVIADNYRTDIVRRAFEDAGIKLEVLRNPKAIHGLLAPRIDTMFAKHNVIYGDNPLMRWFTNNVAVKIKPDGNKEYIKKDEVRRKTDGFMAFVHALYRADDIVDKDMSKALDALMSIDF

SEQ ID NO: 684 - protein, 152 aa, Unknown
  Description of Unknown: Undetermined Phage F91a/06 polypeptide
MSILEKIFKTRKDISYMLDLDMIEDLSQQAYVKRLAIDSCIEFVARAVAQSHFKVLEGNRIQKNDVYYKLNIKPNTDLSSDSFWQQVIYKLIYDNEVLIVVSDSKELLIADSFYREEYALYDDIFKDVTVKDYTYQRTFTMQEVILFKVQQQ

SEQ ID NO: 685 - protein, 128 aa, Unknown
  Description of Unknown: Undetermined Phage F91a/06 polypeptide
VTHFVESLFEDYGKIFGRMIGAQLKNYQIRGILKSASSAYDEKNIEKLQAFTNKLFNTFNKNQLAIAPLIEGFDYEELSNGGKNSNMPFSELSELMRDAIKNVALMIGIPPGLIYGETADLEKKHACI

SEQ ID NO: 686 - protein, 82 aa, Unknown
  Description of Unknown: Undetermined Phage F91a/06 polypeptide
MYLKDTRIEIVGVNKKDPLQYAEAIDKLVSSGSFTRNEVRIMLGEEPSDNPELDEYLVTKNYEKANENGSTLKGGDEDESGD

SEQ ID NO: 687 - protein, 245 aa, Unknown; identical to SEQ ID NO: 620
  Description of Unknown: Undetermined Phage F91a/06 polypeptide

SEQ ID NO: 688 - protein, 168 aa, Unknown
  Description of Unknown: Undetermined Phage F91a/06 polypeptide
MTINLSETFANAKNEFINAVNNGEPQERQNELYGDMINQLFEETKLQAKAEAERVSSLPKSAQTLSANQRNFFMDINKSVGYKEEKLLPEETIDRIFEDLTTNHPLLADLGIKNAGLRLKFLKSETSGVAVWGKIYGEIKGQLDAAFSEETAIQNKLTAFVVLTKRFK

SEQ ID NO: 689 - protein, 193 aa, Unknown
  Description of Unknown: Undetermined Phage F91a/06 polypeptide
VALETAFLKGTGKDQPIGLNRQVQKGVSVTEGAYPEKEEQGTLTFANPRATVNELTQVFKYHSTNEKGKSVAVKGNVTMVVNPSDAFEVQAQYTHLNANGVYVTALPFNLNVIESTVQEAGKVLTYVKGLYDGYLAGGINVQKFKETLALDDMDLYTAKQFAYGKAKDNKVAAVWKLDLKGHKPALEGTEETL

SEQ ID NO: 690 - protein, 75 aa, Unknown
  Description of Unknown: Undetermined Phage F91a/06 polypeptide
MVKFKVVRAFKDIEHNQHKYKVGELYPAEGYNNPRVELLTNQIKNKYDKVYIVPLDKLTKQELLELCESLQKKDV

SEQ ID NO: 691 - protein, 98 aa, Unknown
  Description of Unknown: Undetermined Phage F91a/06 polypeptide
MVKTMTIDDLLVKFKSLEKIDHNSEDEYLKQLLKMSYERIKNQCGVFELENLIGQELILIRARYAYQDLLEHFNDNYRPEIIDFSLSLMEVSEDEESV

SEQ ID NO: 692 - protein, 120 aa, Unknown; identical to SEQ ID NO: 624
  Description of Unknown: Undetermined Phage F91a/06 polypeptide

SEQ ID NO: 693 - protein, 134 aa, Unknown
  Description of Unknown: Undetermined Phage F91a/06 polypeptide
MSVKVIGDKALERELEKRFGIKEMVKVQDKALIAGAKVIVEEVKKQLKPSKDTGALINEVSFSKPEWINGKRTITVHWRGSKDRYKIVHLIEYGHVQKGTGKFIKPKAMGGVNRAIRQGQNKYFETLKRELKKL

SEQ ID NO: 694 - protein, 135 aa, Unknown
  Description of Unknown: Undetermined Phage F91a/06 polypeptide
VIDILYKVHEVISQDRIIREHVNINNIKFNKYPNVKDTDVPFIVIDDIDDPIPTTYTDGDECAYSYIVQIDVFVKYNDEYNARIIRNKISNRIQKLLWSELKMGNVSNGKPEYIEEFKTYRSSRVYEGIFYKEEN

SEQ ID NO: 695 - protein, 89 aa, Unknown
  Description of Unknown: Undetermined Phage F91a/06 polypeptide
MAIKHASAPKAYFNITGLGFAKLTKEGAELKYSDITKTRGLQKIGVETGGELKTAYADGGPIESGNTDGEGKISLQMHAFPKEIRKIVF

SEQ ID NO: 696 - protein, 83 aa, Unknown
  Description of Unknown: Undetermined Phage F91a/06 polypeptide
MFTNPKIDGETAEKDWDFSSEEVEGEALFPLVDNKKSVRKYIFDSANMTNHDGDGEKGEEAFLKKILGEEYTGNVTEGNEETL

SEQ ID NO: 697 - protein, 46 aa, Unknown; identical to SEQ ID NO: 629
  Description of Unknown: Undetermined Phage F91a/06 polypeptide

SEQ ID NO: 698 - protein, 116 aa, Unknown; identical to SEQ ID NO: 630
  Description of Unknown: Undetermined Phage F91a/06 polypeptide

SEQ ID NO: 699 - protein, 42 aa, Unknown
  Description of Unknown: Undetermined Phage F91a/06 polypeptide
MLKNMDTLMMDLIENGKDANEVLKMPFHYVLSIYQNKNNDIS

SEQ ID NO: 700 - protein, 883 aa, Unknown
  Description of Unknown: Undetermined Phage F91a/06 polypeptide
MGERIKGLSIGLDLDAANLNRSFAEIKRNFKTLNSDLKLTGNNFKYTEKSTHSYKQRIKELDGTITGYKKNVDDLAKQYGKVSQEQGENSAEAQKLRQEYNKQANELNFLEKELEKTTTEFEEFKKAQVEAQRMAESGWGKTSKVFESMGPKLTKMGDGLKSIGKGLMIGVTAPVLGIAAASGKAFAEVDKGLDTVTQATGATGGELKKLQNSFKDVYGNFPEDAETVGGVLGEVNTRLGFTGKELESATESFLKFSHITGSDGVQAVQLITRAMGDAGIEADEYQSVLDMVAKAAQASGISVDTLADSITKYGAPMRAMGFEMKESIALFSQWEKSGVNTEIAFSGLKKAISNWGKAGKDPREEFKKTLAEIERTPDIASATSLAIEAFGAKAGPDLADAIKGGRFSYQEFLKTIEDSQGTVNQTFKDSESGSERFKVAMNKLKLVGADVWASIESAFAPVMEELIKKLSVAVDWFSSLSDGSKRSIVIFGGIAAAIGPVVFGLGAFISTVGNAVTVLAPLLASIAKADGLISFLSTKVPILGTVFTALTGPIGIVLGVLAGLAVAFTIAYKKSETFRNFVNGAINSVKQTFSNFIQFIQPFIDSVKNVFKQAVSAIVDFAKDIWSQINGFFNENGISIVQALQNICNFIKAIFEFILNFVIKPIMFAIWQVMQFIWPAVKALIVSTWENIKGVIQGALNIILGFIKFFSSLFTGNWRGVWDGIVMILKGTVQLIWNLIQLWFVGKILGVVRYFGGLLKGLISGIWGVIKGIFTKSLSAIWNATKSIFGFLYNSVKSIFTNMKNWLSSTWNNIKSNTVGKAHSLFTGVRSKFTSLWNATKDIFTKLRNWMSNIWNSIKDNTVGIAGRLWIKYVISSETCVTV

SEQ ID NO: 701 - protein, 525 aa, Unknown
  Description of Unknown: Undetermined Phage F91a/06 polypeptide
MRDGLKSIIGKIKDHIGGMVDAIKKGLNKLIEGLNWVGGKLGMDEIPRLHTGTEHTHTTTRLVKNGKIARDTFATVGDKGRGNALNGFRNEMIEFPNGIRVITPNTDTTAYLPKGSKVYNGAQTYSMLNGTLPRFHFGTTMWKDIKSSASSAFNWTKDQIGKGTKWLGDKVGDVLDFMENPGKLLNYILEAFGIDFNSLTKGMGIAGDITKAAWSKIKKSATDWIKENLEAMGGGDLVGGILDPDKINYHYGRTAAYTAATGRPFHEGVDFPFVYQEVRTPMGGRLTRMPFMSGGYGNYVKITSGVIDMLFAHLKNFSKSPPSGTMVKPGDVVGLTGNTGFSTGPHLHFEMRRNGRHFDPEPYLRNAKKKGRLSIGGGGATSGSGATYASRVIRQAQSILGGRYKGKWIHDQMMRVAKRESNYQSNAVNNWDINAQRGDPSRGLFQIIGSTFRANAKRGYTNYNNPVHQGISAMQYIVRRYGWGGFKRAGDYAYATGGKVFDGWYNLGEDGHPEWIIPTDPARKK

SEQ ID NO: 702 - protein, 80 aa, Unknown
  Description of Unknown: Undetermined Phage F91a/06 polypeptide
LSNVNGFDDPSLLLKMIEQQQQQIALLLKIAQSNDVIADKDYQPIIDEYAFDKKVNASIEKRERQESTKVKFRKGGIAIQ

SEQ ID NO: 703 - protein, 382 aa, Unknown
  Description of Unknown: Undetermined Phage F91a/06 polypeptide
MIDTIKVNNKTIPWLYVERGFEIPSFNYVLKTENVDGRSGSIYKGRRLESYSFDIPLVVRNDYLSHNGIKTHDDVLNELVKFFNYEEQVKLQFKSKDWYWNAYFEGPIKLHKEFAIPVKFTIKVVLTDPYKYSVTGNKNTAISDQVSVVNSGTADTPLIVEARAIKPSSYFMITKNDEDYFMVGDDEVTKEVKDYMPPVYHSEFRDFKGWTKMITEDIPSNDLGGKVGGDFVISNLGEGYKATNFPDAKGWVGAGTKRGLPKAMTDFQITYKCIVEQKGKGAGRTAQHIYDSDGKLLASIGYENKYHDRKIGHIVVTLYNQKGDPKKIYDYQNKPIMYNLDRIVVYMRLRRVGNKFLLKLGNLITLKTQIDVNLLIWMRKSG

SEQ ID NO: 704 - protein, 118 aa, Unknown
  Description of Unknown: Undetermined Phage F91a/06 polypeptide
MDEKEWIDGGKFYQRPASIIAIYSAKYNGYKWMEMNGLGSFNTEILPKPKGARDVIIQKGDLVKIDMQAKSVVINEEPMLSEKSFGSNYFNVDSGYSELIIQPENVFDTTVKWQDRYL

SEQ ID NO: 705 - protein, 790 aa, Unknown
  Description of Unknown: Undetermined Phage F91a/06 polypeptide
VIHVLDFNDKIIDFLSTDDPSLVRAIHKRNVNDNSEMLELLISSERAEKFRERHRVIIRDSNKQWREFIINWVQDTMDGYTEIECIASYLADITTAKPYAPGKFEKKTTSEALKDVLSDTGWEVSEQTEYDGLRTTSWTSYQTRYEVLKQLCTTYKMVLDFYIELSSNTVKGRYVVLKKKNSLFKGKEIEYGKDLVGLTRKIDMSEIKTALIAVGPENDKGKRLELVVTDDEAQSQFNLPMRYIWGIYEPQSDDQNMNETRLSSLAKTELNKRKSAVMSYEITSTDLEVTYPHEIISIGDTVRVKHRDFNPPLYVEAEVIAEEYNIISENSTYTFGQPKEFKESELREEFNKRLNLIHQKLNDNISNINTIVKDVVDGELEYFERKIHKSDTPPENPVNDMLWYDTSNPDVAVLRRYWNGRWIEATPNDVEKLGGITREKALFSELNNIFINLSIQHASLLSEATELLNSEYLVDNDLKADLQASLDAVIDVYNQIKNNLESMTPETATIGRLVDTQALFLEYRKKLQDVYTDVEDVKIAISDRFKLLQSQYTDEKYKEALEIIATKFGLTVNEDLQLVGEPNVVKSAIEAARESTKEQLRDYVKTSDYKTDKDGIVERLDTAEAERTTLKGEIKDKVTLNEYRNGLEEQKQYTDDQLSDLSNNPEIKASIEQANQEAQEALKSYIDAQDNLKEKESQAYADGKISEEEQRAIQDAQAKLEEAKQNAELKARNAEKKANAYTDNKVKESTDAQRRTLTRYGSQIIQNGKEIKLRTTKEEFNATNRTLSIY

SEQ ID NO: 706 - protein, 480 aa, Unknown
  Description of Unknown: Undetermined Phage F91a/06 polypeptide
MQPIVHFQYIKRDCPNVTDGTTIRYDDNGVAQALNVGPRGIRLNADKIDINGNREINLLIQNMRDKVDKTDIVNSLNLSREGLDINVNRIGIKGGNNNRYVQIQNDSIELGGIVQRTWKGKRSTDDIFTRLKDGHLRFRNNTAGGSLYMSHFGISTYIDGEGEDGGSSGTIQWWDKTYSDSGMNGITINSYGGVVALTSDNNRVVLESYASSNIKSKQAPVYLYPNTDKVPGLNRFAFTLSNADNAYSSDGYIMFGSDENYDYGAGIRFSKERNKGLVQIVNGRYATGGDTTIEAGYGKFNMLKRRDGNRYIHIQSTDLLSVGSDDAGDRIASNSIYRRTYSAAANLHITSAGTIGRSTSARKYKLSIENQYNDRDEQLEHSKAILNLPIRTWFDKAESEILARELREDRKLSEDTYKLDRYVGLIAEEVENLGLKEFVTYDDKGEIEGIAYDRLWIHLIPVIKEQQLRIKKLEESKNAG

SEQ ID NO: 707 - protein, 50 aa, Unknown; identical to SEQ ID NO: 636
  Description of Unknown: Undetermined Phage F91a/06 polypeptide

SEQ ID NO: 708 - protein, 73 aa, Unknown; identical to SEQ ID NO: 637
  Description of Unknown: Undetermined Phage F91a/06 polypeptide

SEQ ID NO: 709 - protein, 76 aa, Unknown
  Description of Unknown: Undetermined Phage F91a/06 polypeptide
MLSTLNEIKLGQKTQEQVNIKLDKTLDAIQKEREIDEKNKKENDKNIRDMKMWVLGLVGTIFGSLIIALLRMLMGI

SEQ ID NO: 710 - protein, 44 aa, Unknown; identical to SEQ ID NO: 639
  Description of Unknown: Undetermined Phage F91a/06 polypeptide

SEQ ID NO: 711 - protein, 67 aa, Unknown
  Description of Unknown: Undetermined Phage F91a/06 polypeptide
LSAIFLFAQNIAKAIGYDIQVYTEQLTDGLNAILGFLVLTGVIQDPTTKGIGDSHQALEYEEPRRKY

SEQ ID NO: 712 - protein, 251 aa, Unknown; identical to SEQ ID NO: 641
  Description of Unknown: Undetermined Phage F91a/06 polypeptide

SEQ ID NO: 713 - protein, 163 aa, Unknown
  Description of Unknown: Undetermined Phage F91a/06 polypeptide
MLKRGLLFLTVLLLLFSFSSITNEVSASSSFDKGKYKKGDDASYFEPTGPYLMVNVTGVDGKGNELLSPHYVEFPIKPGTTLTKEKIEYYVEWALDATAYKEFRVVELDPSAKIEVTYYDKNKKKEETKSFPITEKGFVVPDLSEHIKNPGFNLITKVIIEKK

SEQ ID NO: 714 - protein, 98 aa, Unknown
  Description of Unknown: Undetermined Phage F91a/06 polypeptide
VPAGYTLDKNNVPYKKETGYYTVANVKGNNVRDGYSTNSRITGVLPNNATIKYDGAYCINGYRWITYIANSGQRRYIATGEVDKAGNRISSFGKFSAV

SEQ ID NO: 715 - protein, 149 aa, Unknown [sequence omitted]

SEQ ID NO: 716 - protein, 116 aa, Unknown; identical to SEQ ID NO: 644
  Description of Unknown: Undetermined Phage F91a/06 polypeptide

SEQ ID NO: 717 - protein, 51 aa, Unknown
  Description of Unknown: Undetermined Phage F91a/06 polypeptide
LVNKINKFNQYVARFIPYIATKIPIKKNIAPMIKQKSDAELLKNEVFRVRK

SEQ ID NO: 718 - protein, 345 aa, Unknown
  Description of Unknown: Undetermined Phage F91a/06 polypeptide
MKTRCYDGKKWQYEFKYEGKRYRKKGFRTKREANSAGLDKLNELRSGFNIDNYITLEEYFENWIKTYKQPVVKENTYRHYRNALQHIQKHKIGKMELSKINRQVYQKFINDYSKEHAKETIRKTNGAIRSALDDALYDGLIFKNPAYKVNYKAGKPTKSEQEKFISVTEYEILKDHVRKKRTRSSLALFIMICTGCRVSGARNIKIEHINQVKNTIFIDERKTDTSPRYISIAKSDMKHIMDVISTFAISYDGYIFKEAGSIINLQAINNALKSACRVNNIPIITSHALRHTHCSYLLAKGVSIHYISKRLGHKNIAITTSVYSHLLEEKFNEEDKKTTKILESM

SEQ ID NO: 719 - protein, 157 aa, Unknown
  Description of Unknown: Undetermined Phage F91a/06 polypeptide
LNGGESVSENKGEMMTHNIEKRINKLKTSGNPKFKKLDSDIHYLLKRFEGEKNHKGFYPKFKQGEIVFVDFGINVNKEFSNSHFAIVMNKNDSNTEDIVNVIPLSSKENKKYLKMNFDLKWEYYLRLFLNLISAQNNSAILKEVSIKNTKKQHRIHH

SEQ ID NO: 720 - protein, 52 aa, Unknown
  Description of Unknown: Undetermined Phage F91a/06 polypeptide
MKITNCKIKRETIVYEVLTSGNQPFTYELPKDLSSHNARKYLEFISQKIRWR

SEQ ID NO: 721 - protein, 61 aa, Unknown; identical to SEQ ID NO: 648
  Description of Unknown: Undetermined Phage F91a/06 polypeptide

SEQ ID NO: 722 - protein, 48 aa, Unknown; identical to SEQ ID NO: 649
  Description of Unknown: Undetermined Phage F91a/06 polypeptide

SEQ ID NO: 723 - protein, 259 aa, Unknown
  Description of Unknown: Undetermined Phage F91a/06 polypeptide
MKPRKQDEKILSDQYSYFEPIISDSCDIKFDENKRRMGSIFISHEEICFIRKEEDYIFKISLSEVIDYNTVVTIWKNQAFLTLNDNRKLTVYFVTNSPLTGFISILKTYMQLSKNKETIISNDCLPINDDEQTKVEIFDVVGLNYEGRRKELKKLIKKMKNNDDFFFLYSDLKGNELKEELLYEDKVYEISDYEVIPGVFLQKEPDNPYDENAIKVMISNEYSEFHVGYVPREYASRLVNHMDNIVSCNAYINGGKYKT

SEQ ID NO: 724 - protein, 224 aa, Unknown
  Description of Unknown: Undetermined Phage F91a/06 polypeptide
MNSFKDRLKQIMSERKISQSELSRRTGIGRNSISDYLNGKYEAKQDKVFELAKALNVNEAWLMGFDISKNRKIENNDITSIYSKLTPPRQSNVLKYATNQLEEQNNDSDNLVDFNSYIQEKSEVDIYGCASAGIGERLYNEPISKEFVRGYVPAHDIALKVNGDSMEPLFKNGQIIFIEKSHTIKDGQIGVFIINGDAYVKKVYVEDNRLTLVSLNKKYKDYIL

SEQ ID NO: 725 - protein, 80 aa, Unknown; identical to SEQ ID NO: 652
  Description of Unknown: Undetermined Phage F91a/06 polypeptide

SEQ ID NO: 726 - protein, 37 aa, Unknown
  Description of Unknown: Undetermined Phage F91a/06 polypeptide
MEQITLTKEELKEIIAKEVRNAIKGEKPISSGAISVK

SEQ ID NO: 727 - protein, 46 aa, Unknown; identical to SEQ ID NO: 655
  Description of Unknown: Undetermined Phage F91a/06 polypeptide

SEQ ID NO: 728 - protein, 69 aa, Unknown; identical to SEQ ID NO: 656
  Description of Unknown: Undetermined Phage F91a/06 polypeptide

SEQ ID NO: 729 - protein, 286 aa, Unknown
  Description of Unknown: Undetermined Phage F91a/06 polypeptide
MQALKTKSNIGEMFNIQEKENGEIAISARELYKALEVKKRFSAWAEINLKHFKENRDFTSVLTSTVVNNGAVRQLEDYALTLDVAKHVAMMSGTEKGFDFREYFIQVEKAWNSPEMIMQRALKIANNTINQLETKIERDKPKIVFADAVATTKTSILVGELAKIIKQNGINIGQRRLFEWLRQNGFLIKRKGVDYNMPTQYSMERELFEIKETSITHSDGHTSISKTPKVTGKGQQYFVNKFLGENKQLNRRNEQCKLKTKKSSITTMTKKVIDDPLIFNTTMATT

SEQ ID NO: 730 - protein, 33 aa, Unknown
  Description of Unknown: Undetermined Phage F91a/06 polypeptide
MIDQRFIEMTLERHPHLKNNFYGLIDGKEFKLD

SEQ ID NO: 731 - protein, 126 aa, Unknown
  Description of Unknown: Undetermined Phage F91a/06 polypeptide
MKLDHDCVRHLLLEIETNKKIGEPLTEYNFKDNVVFGKYDFETVMYALLKLEEAKYVSVKFGWEDGHIYGYTINDITWSGHEFLDNIRDNHTWKEVKKVANKTTSMSVTLLSKLAFNYLTQKFNLT

SEQ ID NO: 732 - protein, 107 aa, Unknown
  Description of Unknown: Undetermined Phage F91a/06 polypeptide
MPHILNVTVPIPETHVLITKDEYEELIAYSLDPVWNMSDLKKKLKIASDETIKDRLLFHPRLEKELRAQGIVHYPDENFNRWRFNARRMHKFVDEHFNEIYKGGHNK

SEQ ID NO: 733 - protein, 53 aa, Unknown
  Description of Unknown: Undetermined Phage F91a/06 polypeptide
MSKTYKSYLVAVLCFTVLAIVLMPFLYFTTAWSIAGFASIATFIFYKEYFYEE

SEQ ID NO: 734 - protein, 100 aa, Unknown
  Description of Unknown: Undetermined Phage F91a/06 polypeptide
MTKNYKDMTQEEIKDLLSEKTAELYELAKEIKGESKFDILLFSSIGVIDGDYLAGSSSVIGHTFDLAYLLDSTKSYKDIVNVLQMCKSQKILGIDDDKED

SEQ ID NO: 735 - protein, 86 aa, Unknown
  Description of Unknown: Undetermined Phage F91a/06 polypeptide
MYYKTGDVCRKIFNVDGFDFQLRVKKRAYSVEIVVLDHEGNSIDGLLVSDENDLYTALDILKQSIYEWIENNTDEQDRLINLVMKW

SEQ ID NO: 736 - protein, 92 aa, Unknown; identical to SEQ ID NO: 663
  Description of Unknown: Undetermined Phage F91a/06 polypeptide

SEQ ID NO: 737 - protein, 647 aa, Unknown
  Description of Unknown: Undetermined Phage F91a/06 polypeptide
MKINKLTISNFAGIKEEKFNFDGKDAKIYGNNATGKTTTATALQWLLFDKGLDGSTKSFNPVPLNEKNEENYELIPTVFAEFEIDGKITTFKKESHPKYTINQKTNRKEYSRSRTKKQYINDESIKVKDYKARIDELIDEDVFKLITNPQAFNLLDWKKRRSLLFEIAKPINDEDVIKTNDDFKELNNILGDHEIETKKKILTDKIKQINKDIKDIPIRINQTQQNKQDVPEFDNDRHTIIKQEIEQLENERIDIQNGAEEINLRNQLADKQSELKRIEANNSASNENKIHALTNELHVENGTVANLKTRLKQNKQQITHEENRRNQLLENHKGLKSDLEKAKNQKFEYLDDNVCSCCGQQLPAEQVSEVREKALQKFNANKSKELETIQTSINHIISEGKKIKPIIEKLEDDNNNLQIKINEAEERSARIQNKINKLKITHVDVTQTDEYKAVMLEINEINQKRSNIRKTIQDKVSGIDDKISELTQEKSEIEVSISIEKSNKHLDDVISELRNEEDRLLDEKEKYSHDLYILKEFTTTKVKMLTENINNEFDIAEFKLFNTLVNGELEETCSTTVNGVEYDSGLNNASRINVGLDIINTLSKHFKVTAPIFIDNAESVTELIKTESQQIQLIVNEQDKKLRMETI

SEQ ID NO: 738 - protein, 266 aa, Unknown
  Description of Unknown: Undetermined Phage F91a/06 polypeptide
MKSAMLQLQELKGSKKDGYKPALEFATSTSIANALMDMVVQGLNPAKNQGYFIMYGDKVQFQRSYHGTMAVTKRVAGAEEINAEVIFEGDEVKYKTKNGKIVELEHTQSFGNRNTQNIIGAYATVVFKDESRNYTEIMTFEEIEEAWKQSQMVYNGVFKEDGTHRRFPQEMAKKTVINRACKKILNSTDDASLLSNQIKESEQRQRKEVLDAEVEENANQEQLDFEPPVFEEAQYTELENEKPIDVSDFEEIKEPATEKESEEEPF

SEQ ID NO: 739 - protein, 161 aa, Unknown
  Description of Unknown: Undetermined Phage F91a/06 polypeptide
MTAGTQRAMDFESHRLCTIKAKQELRIGTWSILPFDIEHDANEPVAFLLQSTLGYKVLYVTDTKYLKYKFNGITHMMLEVNYIYEQMQENIKNGSVHSALANRIMESHFSLEHAIGMLKANDLTRLEEIHLIHLSSQNSNAKYIKSEIQKVTGAPVYVGGL

SEQ ID NO: 740 - protein, 156 aa, Unknown
  Description of Unknown: Undetermined Phage F91a/06 polypeptide
MLNRTILVGRLTRDPELRTTQSGVNVASFTLAVNRTFTNAQGEREADFINIIVFKKQAENVNKYLSKGSLAGVDGRLQTRNYENKEGQRVYVTEVIADSIQFLEPKNSNDTQQDLYQQQVQQTRGQSQYSNNKPVKDNPFANANGPIEIDDNDLPF

SEQ ID NO: 741 - protein, 278 aa, Unknown
  Description of Unknown: Undetermined Phage F91a/06 polypeptide
MTGWISIDRSIQNHWLFKEKRTFSKFEAWIYLLMEANHSKAKVPIGNQIVTVERGQRLTSILTLSDLFNWSRFKVKTFLDLLESDGMLEVKTTSKYTLITIVNYDFYQSEQGRNQHQNDIKPTSKQHQSNINPTSKQHQTNTNNNDNKDNNEKNVNNEKKKTTAFDFFQDNGFGFITSYNLDDLNYYLDSFENDSDEIVTASLKIAKDRNKVTWGYAKSILNTWLNANLKSIEQVRAFEKQQLESKKQNYKPFVKQSKEKTTQMAHRQHERNENAGSR

SEQ ID NO: 742 - protein, 72 aa, Unknown
  Description of Unknown: Undetermined Phage F91a/06 polypeptide
MDAFDKYYLFDHDGNKMFSVTPHFKDGRHLVVGIKETKFNGRRWYLDDYELNTLIDNEQMELGHQTSLFEYI

SEQ ID NO: 743 - protein, 138 aa, Unknown
  Description of Unknown: Undetermined Phage F91a/06 polypeptide
MRDYMEIEIKFNEVFNAPMGSPRPRFRNTGRFVQTYMPTSYTKHKAYIQGQMPKLNLERALKIELDFYFPLLKSWSKKKKSEMVGQYKVTKPDIDNLIKTVLDACNGHVWKDDNQITEITSSKRYGIEPKIIIRIEEI

SEQ ID NO: 744 - protein, 123 aa, Unknown
  Description of Unknown: Undetermined Phage F91a/06 polypeptide
MARKARIVTINDKPYRFSKFEMELIESHGITAGMVSKRVKDGWELHEAMDAPEGTRLSEYREKKTIERLEQARLERKLERKRKREAELRRKKPHLFNVPQKHSRDPYWFDNTYNQMFKKWSEA

SEQ ID NO: 745 - protein, 85 aa, Unknown
  Description of Unknown: Undetermined Phage F91a/06 polypeptide
MSVISNRKVDMNEIQDNVKQPAHYTYGDIEIIDFIEQVTAQYPPQLAFAIGNAIKYLSRAPLKNGHEDLAKAKFYVQRAFDLWEQ

SEQ ID NO: 746 - protein, 37 aa, Unknown
  Description of Unknown: Undetermined Phage F91a/06 polypeptide
VPGWQSVKKTFDTAEELEIYIKQHGLEYEEQKQLTLF

SEQ ID NO: 747 - protein, 84 aa, Unknown
  Description of Unknown: Undetermined Phage F91a/06 polypeptide
MEMMNNREQIEQSVISASAYNGNDTEGLLKEIEDVYKKARAFDEILDGMTNAIQHSVKEGIELDEAVGIMAGQVIYKYEEEQGK

SEQ ID NO: 748 - protein, 101 aa, Unknown
  Description of Unknown: Undetermined Phage F91a/06 polypeptide
MTNTLTIDQLQELLQIQKKFDDRIPTRNLNDTVASMIIEFAEWVNTLEFFKNWKKQPGKPLDTQLDEIADYLAFSLQLTLTIVDEEDLEETTEVMVDLIRK

SEQ ID NO: 749 - protein, 78 aa, Unknown
  Description of Unknown: Undetermined Phage F91a/06 polypeptide
MKLLYLNYIQFIFVHVMHTLTEQFVKGIDNSIVQVLIMPFLYANTYYTIDQLIDAYKKKMKRNHERQDGTADAGKGYV

SEQ ID NO: 750 - protein, 81 aa, Unknown
  Description of Unknown: Undetermined Phage F91a/06 polypeptide
VSDMLEIFLIGFGVYLFYRIAIIFLKSKKTIHTNIYEMLMLATIFMISTIAYKHQKTHILIAFLVMFFMSKLKQVQGSYEE

SEQ ID NO: 751 - protein, 68 aa, Unknown
  Description of Unknown: Undetermined Phage F91a/06 polypeptide
MTQYLVTTFKDSTGQPHEHFTTARDNQTFTVVEAESKEEAERKYEAQVKRGAVIKLGQLFENIRECGK

SEQ ID NO: 752 - protein, 49 aa, Unknown; identical to SEQ ID NO: 612
  Description of Unknown: Undetermined Phage F91a/06 polypeptide

SEQ ID NO: 753 - protein, 66 aa, Unknown
  Description of Unknown: Undetermined Phage F91a/06 polypeptide
MWITMTIVFAILLLVCISINSDHAREIQALRYMNDYLLDEVVKTKGYNGLEEYRIELKRINNDIKK

SEQ ID NO: 754 - protein, 138 aa, Unknown; identical to SEQ ID NO: 680
  Description of Unknown: Undetermined Phage F91a/06 polypeptide

SEQ ID NO: 755 - protein, 126 aa, Artificial Sequence
  Description of Artificial Sequence: Synthetic polypeptide
NGLVGKGVDADGWYGTQCMDLTVDVMQRFFGWRPYGNAIALVDQPIPAGFQRIRTTSSTQIKAGDVMIWGLGYYAQYGHTGIATEDGRADGTFVSVDQNWINPSLEVGSPAAAIHHNMDGVWGVIR

SEQ ID NO: 756 - protein, 136 aa, Artificial Sequence
  Description of Artificial Sequence: Synthetic polypeptide
DNSLGKQFNPDLFYGFQCYDYANMFFMIATGERLQGLYAYNIPFDNKARIEKYGQIIKNYDSFLPQKLDIVVFPSKYGGGAGHVEIVESANLNTFTSYGQNWNGKGWTNGVAQPGWGPETVTRHVHYYDDPMYFIR

SEQ ID NO: 757 - protein, 122 aa, Artificial Sequence
  Description of Artificial Sequence: Synthetic polypeptide
RWYQGRYIDFDGWYGYQCADLAVDYIYWLLEIRMWGNAKDAINNDFKNMATVYENTPSFVPQIGDVAVFTKGIYKQYGHIGLVFNGGNTNQFLILEQNYDGNANTPAKLRWDNYYGCTHFIR

SEQ ID NO: 758 - protein, 122 aa, Artificial Sequence; identical to SEQ ID NO: 757
  Description of Artificial Sequence: Synthetic polypeptide

SEQ ID NO: 759 - protein, 122 aa, Artificial Sequence; identical to SEQ ID NO: 757
  Description of Artificial Sequence: Synthetic polypeptide

SEQ ID NO: 760 - DNA, 43016 bp, Unknown
  Description of Unknown: Undetermined Phage F1245/05 polynucleotide
cgggttcgatgtaacaatcgagcctattgcacaagacaaatatttcttagttgattcaaaacaaattcgtgagtaccgaggttaacatgtttcttaaattatttattgctatatacacagaacaacatctaaatgctgccaaaaacgagcttgagcgtttagggtataagtgtacaagtgatttccatagcgcattagatcaacctgttacacatattactacatatcctaacggcacatacacaatatggacgcttgatcttgatatgtgtcgtcgtttagcacgtgctaataccacagtacgtgttattaatctccgtcagttacgtggtgtacatcgtcgtttacgtacctcatttagccaagacaatcactctaagcttgagattgtacctgtacgctctgttaatatcttccctgaacttgagaaactaagcccgttagagacggaagcaatgcaagctgcgattaagtggtcttctcctaaagtacctacacctaatgtattctttaagctatggtataacacagcgattagctggaccaaagcaattgttaaccgtttagttcgtcactttaaataaggagctgttgtgagtaagatcaagatgaatgaataccgtggtaaacctccatactctatggatgatcttgctgaggaccctcaattagaacgtcgttacattcaacgtgaacgtcgtaaccatgttaaggagcgcgaccttgatcgacgtaacaaacgccaagccaagcgaaacgggtattagaatacctgtacgtatcaagatcaagtcagtcaagcactactgtaaggttgtacagtgtttaaaggattatggtgtgcaagtacctgctgaacttgcggatgaattaaacctcagacgcaataaggagtactgtaaacgtgcttgggtatggataggtactaatgatgtggcgtgggtgtttggctcttataaaatagttaaatttgctaaggtgatgacacgtaaggagtacgtaacgtggcgacaatccacagctctgaatggttagatcaagcaaagaaagtaccagtaggtcagaagcgtcgtgtataccatggcgctgagatgacacctgctatggatgtatggaacaatgaggactcatggagttgttattgtcaccgttgtcatgcaggtggtaaggtgtataaacagttcctacaacgtgttaatcctgaacaaccagtataccgtaagtacttgaacactaaagacttaataactattgacgagttatacagtaccgataagctcaagtacaaacgtcttatgaagctcttacatgataagggtatgagcatgataaccattgcagcattgaagcctatgtacaataaggttgatgatagacttgtgtttagattcaaaggtgttgatataggtcgtgactgtactggtttacatggggctaagtggttagtgtatcattcagataatccaagcgggtacgtgtacttgcaaggtaaaaatccatattgcacacgagagcctgttatcttgtgtgaggatttattctctgctcagaaggtacggtactatactggatggtcttcattgtttcttatgggtactaactttaaagacgagactgctcatttcttaatgagtagattacctgtgatagcaactgatggtgatgctgctggatgggcagctagaaaggttatacgtacacggtgtgagatgtttaatatacctgtgcaatctgtggatgttcctgtaggtcttgatcctaaagatatgaagcctatggaacttattaatttatttaaacacttggagaaccctgatgggtagtaaatataatcggattaaattccgtgtaagtcgtcgcagtgagtggttactaggtatccaacatgccgagaataatggcttccccgttggccctgaccatgaatggaagattgaacgttatcgtggtggtaaagcgctaattaatgtacgtcttgattataatgatacaggtttaaaccctgagtcttggtatagtacacccataggtactgcactatgggtggataccctaggagactttaaacatgcagttaactgtttctgtcacgatggttacttagacgttgataacttaaaggtggtgtaatatggctataataagaatcccaattagaaccgaagcagaggctaatcaattcatctctattgtgaaatcgcaagggttagcactacccgatcttgatgtagttcatcgtttaggcttggctactgcacgtgtaggtagtgatgcctgtgtttggacaggtattgaacagtacataggtacacgtcatgatttcccacattctgatgagactgtaacagtaaaccaattatataaacgactacaggagcgataatgtcagatttgaacctactccgtgtaatgatggagcgtaagcagttcacaggttctttcaaatcaatcccgatggatttatacgatcctcacacagtcactatgcttggttggtttaagttgtactacaagagttatgaagatcatgagcgtattgatgttgatacgcttggttctttaattaaactcaagactaaaccacacgaagataaggccaaacgtgacgctcagacagctttaatgaatgagatgctacgtaacctcaagcaaccgcttccgttggatatacgagcaaccacgctgaatgcgcttgaggaaagacggcttagtgctgaggcagctatgatctgtcgtaagtacgatgaaggtgaagagattgatgtaatctttgaactgaataagttagcgattgcaactaagcaacgggttgaattacagactcatgcagcttggtgcgatacggatgtttgggaactcattcaagccgatgcagatgatgcgggttatgtgtttgacttcttaccagaggagttctacacaaacattaaaggtgtgaacgagggtaacaacatcggcgttgctgcacctacagacaagggcaaaacatccttccttgtacgtgtcgctgtaagcttcgctaagcaacgttttaaacgtatgcagaatgatgactcaatgaagttccgacctgtcttatacctcgttaatgaaggcacagcagaggttattacaccgcgtgtatatcagactgcgcttgagattaatcgagagcagatgtgggcacgcggtaaatctggtacgatcacccaagactatattaatgttatgggtagaaaagatgctattcgcttaattaacattcatggtaaatcagtggcacaagtggcccgcatcatcgaatcacatgatccattcttagtgatctctgacatgactggacgtattaaagctaatggcggtgcaaacggtagtaatgatattgcacagctggaagaagtctggaatgatatgcgtatgcttgcagcaatgatgaacttcatccatgtaggtacagcgcagattagtgcagaagggtttgataatctgtacccaccattgagtgcattacagaatagtaaaacaggtattcagactacgttagacttaggtatctggattggggcatacgttaaccctgcaccagagaatgaagatttacgtgggattagtactcctaaaaacaaactggtcaagagtggtaaacgaagttacaacacagtgatgacgaacttcttacctgagacaaataattggaacgcagtaggatgaaatttaaacgcggcgatatcgtaaaggctgtaatgactggtggttgttacagcataacttctggtcaaatgtatgaagtacttgatgtacgagcaggtgggaacattaacattaagccgagtcgtgggccttgtaattggtccaaatctcatcgttttgaattggtacgtagtaaagaagatacagtaggagtgcaaccaactatgaatattaaattatatgatacagtcgttcgcacaaccattagccatcatttaaagattggtgagaagtacacagttacaacactatatccacagagtaatcatatcgctgttgagggttttccgaatatgcgtttcagtgctgctgactttattgttgtacctgaccttgaagatcgacctaagtcattagggtttgataaggtatgtgctgcattgaaagatggtacacccctacagtacttcttcaatgagaagtgggtggatgtcgtacgtcctgatagtatcagtataggtatgattaataaaagtatctggcgttatgcaattaacacgattgactactatggacaggaaatccctgcacctataaagcaatatcctagtactggccttgtgtatggtatctcattgactaagcatgaagtctataaatgcaatgtgaacaaacgtctcgggcaattgcactataagactgctgaggatgcacacgctgtactcacaactatattagcgccgtttggtatcacaccgaaggcacttgatttctcacttacacaagaggttatccaatgagtttacgtgaacaagtacgtaagtacctagatgttactaaatcacctgtacaacttgttaagcacatggatgaggtacttgagaagaacatcaagtaccctttaatagctcaacataagtacgacggtgtatacgtcctagttgctgtgactgatggtatccctacgttatatagtcgcacaggtaaagagtgttttgaaggcctctataatactgactttgtgatgagtttaaatggtatcactgatggtatatacattggtgagttatgtaactctaagtttagtcttgaggtgttcaatggtcttgtgagtactaaccgtaagaaaagttgggaagatagtgagtcacaagatactatccagttacttgaagagcatacattcattatgttccatgattacatattccataactgtttattagaaggtcattgtaaacttccttattgggcacgttatgatttactacgtaagagattacgtgtcgcagaactactagattaccttgttgtatccgacgaagtgaaaagccgtgaagatgcagatgcctatgcacaactgattattgatgtaggtggtgaaggtgctgtatttaaacatccagcagaagagtgggtagcaggtcataaaggttatcgtacaatgaagattgtgcgggacttggtacttgatctgctatgcgtaggagttgagtatggtaagggtaaacgtgaaggtcaaattgctaagcttaaattctcttataagggcagtgtgttctccgctgacttgggtaaggggtggacggacgagaaacgaaagcaactcacagagcattatgaaatctaccaaagctatgaaccagagatacaaccagcaatcgaagcatatacacctgtaggtaagatttgggaagtcaaagcccttcaagaatcaagtacaggtaaggcattacgattacctaaagtagttcgagtacgcgaagataagacagaacctgatgcgtaacacaatcttacacaaattgatctaagtacttgatttaatgtactaaatcattgttattatatgtaacataaacctttaaaattgtagatttctattaatataagtctatgattttaaaggtaattattgaatgctacatgtataagatagatagattccagattggagattatatgtcacagattaattggttagtactagactttgaagtacagaaccatgatcactatggatcattagcaagtccacatcatccagataactacttagtagcaactggttggtcggaagatggtaactctgttcaagctgaatatcatcatagtaaagatgaacagtactgtaaacgattcgctgatgcattaagtagagctaagaatctagtagctcataacttaacattcgaattacactggttgatgaaagtatatcctaatgatttacaagcattcattaatcgtggaggtagattcttctgtacacaatacgctgagtatatcctaagtaatcagattgaaatgtatccgaacttagaagacacagcacgtaagtacggagggtcacctaaagtagatgctgttaaacttctatgggaacagggtgtattaacagcagatattgatcaagcattattaatgacgtacttagctgctgatggtaagaatgaatggtctaatccagaagacccatctttccaaggtgacgtagcgaatacacgtagagcttgctttgcacaagtagcggagttacgtaagcgtggtatgatgggtatgtttaaagaacgtatggattcattgttgtttaatgcttgggccacttataacggattgtatgttgacttacctactgcacagcgtaaccaagctgaacaggagaaacaaattgctcaaattaaatctgatattcttggtatgttacctaatgatttaccagatgatttggacttctcattcacatccgattatcacagatcagcgttcttgtttggtggtacagtcaagtacaaagcgaaagtaagttatgatcctattaagtacgagcaaatcgaggtttatggttggatcggacccgaaggtaacacctactacttagccgaagatgatcccatgttacttacaggtgaatttactcagattgtttttaaagcaggtaagaacaaaggacaacctaaagtatttaagattgactctgatgtggagaaacttaaatggggtgagaaagagttcaagttcaaaggtcttattgatttcaattcactacctaaaattgttgcagatgcttatattggtaagcgtgcagagttcaggggtaaacgggatttagtagatggtacacctgtatatagcacaggtaaggatagcttggatgtacttgcaaatcatactgaggttgcaaaaccattaaagctcttggctgcgttgattaaagatacaactacgtactacctcacagatgacggtaaggggatgttgaagttcgttgaacctaatagcatcattcaccaccaactaaacaactgtgcaacgattacgggccgtttatcgggtagtaagcctaacatgcagaacatcccgcgagatggtacatcaaaagttaaagagatgtttagttctcgctttggtgaacaaggtcgtatcgttgaggtggattattctgcacttgaagtagtgacactcgctagtatttctggtgataagaacttactacgtatgttgattgaaggtattgacatgcactgttatcgcttagctgcaaagcttggtgaggactatgaaagtgtattcgagaaatgtcataacaaagatcatcccgatcataaacagtacaaacaatggcgtacagatattaaacctcgtgcctttgcccaccaatacggtgcaagtgctgagggtattgcgtactcaactggttgtacaccagaggaagcttatgaatttaaacgtattgaatttgaactattccctgaatctaatgagttccctgctaaattcgttagaccgatggtcgaaaagactggtctagaaggattacctaaacgtgaacaaaatccagaaacaggtcaatggtcattgtaccgtcaaggttatttccaagctaaatcgggtacatgttattctttccgacaattcgagaaacgcgtcgaaggtcagaagatcatggactacaaggacacacagattgctaactactggtgtcaaggtgaagcatcattcattgtgcaagctgcttgtggtcgtgtcatccgtgagcttattaagcggaactttgctgatggtttggttcttcctattaacactgtacatgatgctatttatttagattgtgccacagaagaattagctaaggaatatggtgcattagttcgggatattatggagcagacacctaagtacttagcagaagctatcccagcacttaaagattggaattaccacattactcctttccctgctgctgctgaattcggtattaatatgatgagtaaacaggacgtataatcattctgtactcacaactcaattattctattaactcattggagacatatactatgacatttaacgcacttgaactcgtacaaggtattgacacttctactttagctgacatgactgacactacaacaggtggtggttctaaacgtggattgttacctgctgggttcgcttttgctgtattcagttcttacattgaatacggtaaacagccacaaatgtttgatggtaaaaagaaagaccctgcattagagttccgcttaggattccacattgtaggtggtgttggtactaacttagcaggtgaggatgaagattatgtacaggacgggttcttacctacaatcagtacatgggatactgctcaatcccgtaatgagaaatctaaggcagttaagtactttaacgcaattaacatcgtaccaaagggtacacacttcattcagaaattaggtactatgtacttggttgaggttaaagtaactaagaacaagaagactggtaaagatcagaatgagttcgactttacatcattacagcaagcccgtgatcaggcaacacgtaaagcatacacatcctacacaaacgcagcgggtattgaggttgctatgggtgaacttaaaccagaagactacaaagtattcctatggaatcgtccaacaaatgtgactatagagcaatatcaagctatgtgggatagtatcgagattaaaggtgagactgagatcaaagatgctgctggtaatgttactggtaaacgttctaagaacttcttacaagagaagtgtcaacgtgcattagactttgaaggctcaagtttacaacaacttattggcggtgtagctttaccaagcattactgcggacgatgaagccgaacctgaacctgctgaggaacttacacctccaccattagatgacgaagctgacttagttgtaccacctgcggatgaggaataatcatggaagatactaatcgtgcaacgggtcgtactacacgtatgatccttaaagctgtagagtacttaatcaaacatccaaaaaagactgtgcgtattgtgtgctataacaattacggttgtgtatggatggctgactatatcaaatcaattgtatctgataggttatggcaacgcattgagttggcgacttatcagcactggcaatgtagtggtataggtaaacgggatgattacttctttgatcatcactgtttctaccatgaggtatataacttaaacaaccgacttaaagaagttaaagctcaactagagcgtgctgagaaggactaccgcaaatatgatgcctaatctaagtcactttgggttagacgctcagacacttagtgatcaaagcacattcaagccaagtaaaggggatagcaatatcctcctttacgatggggatggtggttgctatcagtctgctgctggtgctgcaaagcaagaaacagctatgcgtcgctttgaacgggatatccttgagaacatgtttctcgctggatgtacaaaggcccgtgtacatttaacaccaagcggatgttttaagaacggacggcacttactactaggtgctaagaagtatcaagacaatcgcagtaataagaataaacctcaacatcttgagtatctacgtagtcctgcatctgtagagtacttcaaagatcatgaagatattgagataatccttaactatcgagttgaagcagatgatgctctaatgatggatcattatagatatcataatggtatcttagtgagtcctgataaagacttaaacatctcaccatttaaatcatataaagccgagttaggtaagcacttagttctacccgaaggtgatcgatatggttggattgatcgtgagttctggttaacacctagtcagaagccaagcagtaagatgattggtaaaggtactaagttcttcttagctcaattacttatgggtgatacagcagataatgttaagggtattctaaagctcaatggtaagctttgtggtgaaagcgctgcttttgatgcattgaatcccattacagacgagcatgaggctgtgaacttcattattgaggcttacaagaagattgaccaaaacatcattccagaagcagaggccatgtggttattacgtaaccctaatgatagtgccttcaaatacctgtcagagcataacttaaccgatagtaacttaaacttcttaaacgaatgctaccacgaacgcaagtggaaattagacgaaactgatttggagtacactgatgaattataatgaaactcttaaacgtgctgagtttgctgtacagattcttaatgctgctggttatgatgcacatattgtaggtggtgcattacgagtacaggctctaggcggtacaacaaatgatatagatattgctgtaatcaccacctttaaagagggtgaattacttaacaaggacgtaaatattttacttgaccgcttaggttttaattttaaattacagcatcaaaattcagattatacagatgactctgatttatttatagctgactggtgctcaggtgatattaaccttattgcatataatcgtagtgtgacacctacggtacgtgatctagttaatacatttgaccttagtattaatatgttctacaaggaaaatggtgttttaaaaaatgatgtgtggttgcagggtgtatgtgctgtagttcttaatcccaatcgtctaggtcataatccaaaacttaatgaacgtatcgcacgttttaaacaagaatatgatcatctagactggtcaccagtcgacaaacagcttgcaatagaggagcatatgaatgccatcctctagaccattacaacgtatatcccgacaacaattaaaaggtatcatgattgcactataccaacgtcaaggtaacaaatgtgcaatctgtggtaagcctattgactttagtattacaggtcataaagcaaattacgccgtggatcataatcatgagactggtgagattagaggcacactacataaatcatgtaactctgcggaaggtaaggtaactaatgctgctggtcgctggggatgtaagagtactgactacaatgatgttatcccttggttagagagtcttattaactatctcaagacagctcatcgtaatggtacaggtatgatgtatcctgatcataaaacaccagaacagcaaaaagatgctgctaatcttaaacgtcgtaaacagtatgcagctaagaaggctgcggagagaatgaatgcaagtcggaagtaaggttgtctgcgtttatgcaggtgactccacactaattgaaacacatggtacatatgaagtcttaggcttctctagctatgatggccctaactctcatgtagagatagggttagatggtcgtctcttgggtagttactcacctaagcgttttatgacagttgaagaagtaactaaacaaactcaggagaatttgaatgactaagaaacaccatgctttgaaaggtattaaactcgacattatgaaattatggtgggatggtaaatcttatcagcaaatcgcagaggtggtatgtaaaccttatgatactgtatacggtatcgttcaacgctatcgtgatcaacaaccgcctgtacagcatacgcgtaagcctacgatctttgttattggtgacacacagtgtaaacaaggtatagaccttgcgtacttgcattatgttggtaattacatcttagagaagcgacctgatatcattgtacatatcggtgatcattatgacatggcctcactcagcacctacgataaaggccaactaagtgcagaaggccgtcgagttgctgaggatatcaaagcaggtgataagggtatcgagatcattgagaactatattgcacgtgctaaagattataaccctcgtaaggtagtgacactaggtaatcatgaagaacgtatcgatcgctttgttaatcataaccctgagtttgaaggtcttatcggtacagataaactagcctttgctaactatggttgggaagtatacccattcttaacaccagcaaatatctgtggtattaactttgtacactttgtacagaatggtatgacaggtaaacctctcggtggtactgtgatgactcgattgaagaacgtaggtgagtcatttgtaatgggccaccagcaagtacttgaccattgtttacgttacttacctttaagcggtaaggctcagatcggtgttattatcggtgcttgttatgagcatgatgagggttataaaggtgttcaagggaatcatcatttccgtggatgtgttatgctatacgaatgcgaagatggttatggtttagttaaacctgtatcgcttagtcacatgaaagaagtttacgaacgtcgaggtactaaatgatcatagatggtactaagctgcgctgtataaatgacaaaggtcaacgtattgtcaaagaaggcagcctatatacagcttgggttagagacggtataggtatagatggcagaatctttattaaagaacataaacgttttgcattgttaattactagatttgaggtggttgaatgaagattggtttgattggtttagctggtgctggtaaagatacttctgctgtaatcctacaacgtgttcttgcagagcagggcttaaaatttgaaattgaccgttatgctgcaccattaaagaatgcagctaaagaagtgttcggtgctaactttgatgagcgtaatgtcaaggaagtggatgtgtttgttgatcaagataccatgatcgaagcatctttccgatgtttacgtcaattaggtttcactgatgacgaagatgagaaagcctctgagttattctttgagcatattggattcttggagtacttatcgccacgtctgtaccaacaattattaggtacggaagttgtacgtgctgtacgtccttctgcttgggtagacagaatccgcaggctaaatcgtaatatcattatccctgatgcacgctttgagaatgaagtaagtgattgtaatttattaatcactcgcttccagaatatagataaacctaaacatccaagtgagcatttagcttgggatttacagtttacaggtaaagttctaccagtggatacaatcaatatcaacaacgaacagggtactactttagagcttctagaggaacgtatccgtagtgtagtatcattaatcaatttcaatgaggtagtttaacagtatgtctttgtaccaacgtcagttagagcttgaagaaaaatacagtacaatgagtttagtagctggtcagcagcaaattctagatgcatttaaacagggtagggcttctgacgttggttcagggcgtatcttgttagctaaagcattcgcagcatctttagaagatgttaaggcgttgttagacaaaaagattactggtatcggtggtaagtacaagaagctacttacccttgctagtcctgatgtattagtaatggcagttctacgtgaggtggtcaatggttgtgcttcacctgaacctgtgaccatgcaacaattcctacgttctgtaggtcgtattattgaatccgaatcaatgttagcttgtatggataaagtaagtccagagtatacaagtcgtacagtgcagtatctagattcagcgggtacgaaaagtattcaacatcgttaccgtacttttttaaagggtgctgagaacattaacttacattgggatcagtggagttctgaggaacgtactggtacagctaagttaatcttaggtgttatttacgaaagtactggtctatttaaatggaaaactaatccacatagtgcaagtgatagtatgtactaccttgtacctagtgaggaattagagaagcatttcggtgaggtacaagccgctgcacgagcagtagttaagtacccgcctatgctaatcccacctatggattggcaaggttataatgaaggtggttatatcacagattggttccgtatgcattctccgatgtgtggtattcgattcatcaaacctgaacataagaaatggatcattgagggccttggaaacgctcaggctgctcctgtacgctctgcaatgaataaagcacagaatgtaccttatcgtgtgaatcatcgcgtattgacgatcctacgcactgctacggctatgcgtgtaggtattctaggtttaccgagttttgtagctgctccacaacctgagttcccattaggtttaaactggcagaaagaggatgccactgctgccgagcttgaacagtttaacttctggaaatcacagatggctgcatggtatactaatgaagctaaacgtaaaggtcgtcacatgggtatcttaggccgtattaatgagctagttgcttatgaaaacgaagaacgattgtacttccctacgttcattgattggcgtggtcgtttgtacttccgtagtaaccttaatccccagtcttctgatgctgttaagggttgtttggaatttgctgagggtaaacctcttggtaaagaaggtcttaaatggttaaaagttcatgttgcaaactgttgtggttttgataaacatgatgctgatactaaggagaaatggtgtgatgagaactggtcacaaattgaaaattttatcgataacccactcgatgtggatgcgcccgaacctgacacagcatttactttattgcaggctggattggcacttaaagctgctctcgcccttagtgacccaacgacctacatatgccatgtccctgtcgcaatggatgctacttgctcaggcttacaacatttatcagcgcttacccgcgatccagtcggatcatactacacaaacctagttgataataacacagatcaaaagtctgatatttatatgcgtgttgcagaagtagcacgtgagttactaccaaattatgttagtgacgcggttgtggatcatttctggcaattgaatgagattactcgttctatggctaagaaccctgtgatgacgtatgtatatggtgcaactttattacgttgtattgatacgattggtttgaacttggttgattcaggtgtggaacctattatggaaggacgtaaggtactctatagtatcacagcattagcaacaccagtaggtaaggcattacgtaaaggtgttgaggatactgtacctgagtctgctaagatgatgaaatacttacagaaagtggttcgtgcgtatcctgaacactgtatgcaatgggtaacacctgttggagtacctgtggtcaattgggcagaaggttctgtagtgaaacgcttattcattcgttctatgggtgtcgaagctattaccatgaaagttggtgataaaacttataatactcgtgcagcagctaatggtattgttccaaactttgtacatagtcttgatggtagtcatttatgtatgactatcaatgctttcgatgggcagattctacctatccatgattcattcgccacacacccgagtgacgttacagctatgcatggggcattacgttctcaatttgttagcatgtactcacaattcaaaatcgaggacttcttaaaattcaatgaagtcgatatcgaaactcatgaagtacctgatcaatgtaacttcgatttaaacaaagtgcttaatgcaccattcatgttctgctaaggagtccttatgttattacttattatcactattcttgttgtagtacttgctgttgttatttataaatcagagaaagaaacagtacgtgaatgtttcggcattctggttgaaggtgtcacattagccaaagccaaatcagacattctcaaagttgctaaggtatggttctatacgttaaagcttacaggtgagctaatcctagtacctttcttaactatcgcattgattttattcattattgcaggtgctacatatcgagcaatcattaagtaagttacacaaagttacatacacttatacactatatcttgaatagttatgtaagtgtatgatttaatttattaaattgaaagctacacgtataagataggagaggactatgtctgtcgataaaattccaaacttcacagaggatcagatatattggttagatagtatatttccagagaatacacaattaaccactaaccctaatgaagtatatgttaagttaggacagagacaagtaatccaacgtatcaaacaagacactgctcgtaagcgtaatgcttataatagggctaacggagggtaatatgggcttaggaagtttcttaaagaaatccattaagaactcattccgtggtggtagtttatacaagttatccgataagggtgataacatgttgcgtgacgtctttggcttaaatgcatttaaagatttagcggctggtcaagatgctcagattcgagctatggctgaacagaataaactaaacactgctaatgagattcagaatgtggtgcagtttgaggacgatgtgaatacgggcggtagctcagatcagcgtcgtcgtaaaaatagtgcgggtgcttatgctcgtgcattaaatctgaacgtctaggagatacattatggcgggagttccagagttgcattattcactcagttccctgtttcatcagtatcgtgatgacgggttattagatcgtattgagacgtatgcactctggactatccctagtgtttttcctcgtgatgaacatacgttctataatgcaaataaaaatcgtaccattgagtatgactatcagtctatcggtgcgttgttagtcaatcgactagcatctaaactagctagatcattattcccagccaatacatcctttttccgtattgactcggatgatcctagactacaacaaatttttaaagcgcgcaagcttgacagtgtaattgagtatgaaaacgctgcatgcgctcgtttattctataatgcatcttatgcacaattagtgcaagcattgagactattaattattacaggtgaatgcctactctatcgtgttaatgatagtatgcgtgtttactccttaaaagattatgtggttaaacgtaacaacgttggtgaggttctagacattgtaatctgtgagcataagttcatggaagaattagaccctgccatgaaagttaaagtaggtgttgtacctgcggatactacagttaagttatatactcgtgttcagcgtcaacttatcaatggtattacttcttggaaagttacgcaagaaatcaatgggcgtgatgttggtactaacatggtttatcgtgataagttatgtccttatatccctgttgtatggaacttcgtaaatggagactcatacggtcgtgggtatgttgaggaatacggtgctgacttttctaagttatctgatctgtcccgtgaacttatgtcttatgagttagaagcacttcgtgtgctgcatctagcgaatcaggctggtggtattgacgtggatgaggtggcgaatgcaccaaacggtactgttgtacatggtagccctgagatgcttcaaccttatgaagctggttcttatcagaagatcgttactattcgtgatgaccttgctgctgtagaggcccgtcttaatactgcatttatgtacactggtaatacccgtgatgctgaacgtgtcacagcttatgaactcaaagcaaatgctgaggaagctgagcaagttctaggtggtgtgtactcacaattagcggagtccatgcatttaccattagcgtacttattattaaatgaggtacgtagtgatattatcaacgcactgaatgcacgagagatcacacttaacatcgtaacaggtattcaagccttatctcgtaataccgagaatcaaggaatgattattgcatgtaacgaacttaacgttgtaatccctgttgtagcacagcttgggaaacgatttaatctagacgctatcgctgataagattttcttgtctaatggtgtcaatatcaaagaaattactcgtactgaggatgagttaagagctatccagaaagcagagcaagaagctcaagctgcgcaggaaggtcaactagcacaggctgctatggcccaacaagctccacaacaactaggtacggctgaatccgcagtcaatgcactgcaacaagtaatgtaagaggtataatatatgtcagttgagaatttaccagaaggtcaccctgcacgtgaagcagcacagcctactccgtcagtaacaccagcggtaacacctgctccgactacacagcctgaaccacaggttgtatatcagaacatccctacttatgacacagactcaattactgatacggctgttaatgtgtttgctacatctgctggtattgaggcatctcgctttgatgcagcattagttaatgcgcttaattatggtgatgaaaagttaattgattacacagcactgacacaaggtctaaaacctgatcaagctgctcaagctaaagcactcgctgcatctgtatttaaagatcgtgttgcacgtgagcaggctcatattcaagcaagtactcaaaaggtatatgctgtagctggttctgctgaggcatggaaagaagcatctgatgcttttaacgttagcgcacctgatcacctcaaagcaattgtacgtcaaatgcttgacaatggtgatgtggagaatgcagctaaattcgtaattgaaactgcgcgaggtacaggaatggttaataacggaacacctccaattcaaggtggtacaggtgcagttcaacaaggactcactcaagaacaatattatgctgaattagcaaaactagaaagaagcgcgggtaaccgatcatttgaaagtggtcaagttggagcagagttccaacgtctacgtaatgcgcgtatcttaggacgtaagcagggcctctaagccttgctgtctgctcacttacctaactaggagaatttatcatggctcaaggtactatttatcaaccaaacacaacccgcgatcattggggtggtgctaattccgatgtggatcagcatttagaggattacactggtattgtggattctcgtttccagtacactcaaatctttggtgctttatctgcacaacgttctgtagctgatcgctcgaatacagtgcgtgtagaccgcttcaatacatctaaagtcaaaggccgtaaggctggtgaggctatcgagtcccaacgtgtgacttctgataagttgaacgtgatcgtagaatgtatgatgtacattcgtaatcctatcgactggatggatgactggactgctcctgaccgtcttgttgaaatgtcacgtaacaacggtacagagttcgctatcgcttatgacgaagcacatatcatccgtttacagaaagcacgttcttgggtagcccctgatcatctaaaacctgcgttctctgacggtatgttcgtacctgctacgcttaaacttactactgctggtgttgcagacctagaggctaatgcttctgctcttgtagtagcacatggtaagattgtagaggcactgatcaaacgtcgtgtccctttaacagatatggttacgcttgtaactccaactgtattcactgagcttgtgaatcaccctaaactaatcaataaagattatgttgagtccaatggtgatttcgctgatcgtcgtgttgtgcgtgtaaatggtatcaacgttgtggagtgtactactttcccaactgcacctatcactaaccacatcttgtctacctctactaatgctaacgcgtttaacgcgactgctgaggatatcaagtgtgagatgatcgtgttctctaaatcacagtctttaatcactgtaactgcacaaccatttacttctaacttctggaaggataatgctgagatgtgtaacgtacttgactgttactcaatgttcactcttgatgtacgtcgtccagatacagtaggttcagtattaattactcgtgctgatacaccataattttaactggcccgcctatgtgcgggcttttgtcgtttaggagatttactatgccacaattatgtgaagcaattatcagtccagcattaactggtcaagcattagaagttggtgatcgcgcatttgaacaaggtaatacacctgctgcaaatgaccgtgtcgctacattagaaggtcaggtacaagctctcttagctttattacaaggtcagcaagctgctggtgcccctgtagctcctgttgaagtggttgctgaggaagtcaaggctccagctaagaaagctactgcggagaagtaacatgcaattagacccgatagattataaagacttttatcgtaacgcgggtttaactgagttggaagagactataactgatctaataaatacattggatttaaaagtacactctactgaggccattgttcacgacactacagttaatacagactgtaacgtcttggtcaatggtcgtcacgtggtgtatactgatggtactggtaatgcaccgccaaccgcaggtctgtatttgcttgagcagacatacataactactgaggttgatcaagaggctatagcgcagacagctactcgatacagtacaggtttattctatacacgtattcgacggtctggtgtgtggacttcttggaacaaagtaggttaattaggtaaactcgaaagggtttactttaagatgtaatccataaatcccaagcggtcgagattatatcttaaagtaaatcaatcactcattaggaggtagtatgaaattattagatgctgttaatgctgcactctcttacatgggtgagcataaaattacacgtgtggagggttctaatcaccctactgtagattctattgtatctgcaattaatcgacaacgtgctgctttattaagtacaggttggtggttcaatgaacttcatttaacaatccctgtagagacagatggtcgcatccagacacctgcgcgctctttagctatttatggtaagagtactcgtgtgtccatggaaggtgagcatctttttaatttagatacaggtagtgtttattttactgagcctgtagatgtacgtattgtacgtgatattgattttgaggacttacctgaatatgcagcacagtacagcctgtatgtggctactgcggaagtgtactctgctgagttaggtgttgataacgtagttagtgttttagatggtctggccaaagatgctattgctaatttaagacaagagaacttacgtaatcgtcgttataacccaagacgtaatgctgttcggcaatcacgttacacatggttccgtaatcgttaggaggttttatggcagttcgtgagggtacttacaaatccttaattcaaggtgtgtcccaacaaatcccacaagaacgtagtgatgggcagttaggttctcaatggaacatgttgtctgaccctgttactggtctacgtcgtcgtgctggtgtcaagttacatgcacgcttaaccaacttatcgtctagctcttatatccgtatggttgatatcttaggtgtgtactacttcatgtgcatcgatacatctactggtactatgaagatttatacctatgatggtgtattaaaaaagacgtatacatctgagtacttgaaagcagtatctaaggcgagtatccgtagtactgtatcgcgtagtagctgttatgttgttaatactgataaagtacctcagaaagttgtaggtgcaacgtctagtacgtttaaccctgcacatggcggctactttagtatccgtgctggtgcattcagtaaacagtacactattaccgttaagtggggcactgttacaaaagagttctctattatgtctgatggcggtagtgcagatcaagtaacgcctgctgcgttagcacagagattatgggcgctagtaggtacagacccgcaagttactgctgtgtttgatgtggtgaatgatggccctactgtagcgcttaaagctaaagctggtcagaaccctgcacaattatctattgaaactggtgactcaagtacctacattatggtatctaatgcgtcacgtgttgcatcacggaatgacttactaggtaatttaccctcattactagatggttacatcatggccgttggtacagagaagaactcatcatactacagatttaatgatcaaactaacgtctggcgtgaagtaggtgcttgggaaaaggattacactatcagtaatgaacctatctactggactgtagatgatacacaaaccgatccctatgtagttaaagagttagacattaaaatgcgtagtgctggtgatgatgagaataacccactacctaaattcattgggtatggtattacaggtatcggtacgtatcaatctcgtcttatcttattatctggttcgtatgttaacatgtctaagactactgatttctcggagtactcacgcactactgtcacagaagtgcttgacgatgacccgattgagattgctagtgcttctttgagcagtacacagtttgaatactgtattccgtataataaggatttattacttattgcacagaaccaacaagctgttatccctgctaacaatacagtcttgactcctaaaactgcggttatttatccaagtactaaagttgaattgagtcttgctaatgaacctcaaattgtatcacgtagtgtgtactacacgtatcaacgtggtgatgattactatcaagtaggtgagtttattcctaactcatacacagatgcacaatactataatcagaacttaacagatcatatttcattgtatgctaagggtgtctgtacatgtattgcatctagtactactaacaacatggccttaatgtcatcagatgatgcagaggtgttagttaatcaatttatgtggggtggcgatgaacgtcttctaatggcattccataaatggagattcatgctacctgttgtgtacatgcagttcctacaagaaaacactatcttctttatggacgatggggatgatgttgtagttgctacattgaacacacagttaaaccagttaactgagaagcctgtgccatacttggatttatactctatgatccctgttactaacggtgtaggtactatccctgattattacttaggtaaagacttcacagtagtactatatgacaaccgtaacttacgtcactacgagattcaaccagaggttgatggtaacattatcaaagttcctcaagatggtaatgtagttattggtttcaagtatgaatctgagttcacactgacacctccattcttaaaggatgagaacggtaaggtgattgcagggtcacgtagcacgttacataagcttgatatggaatttgttaacactggaagttttaaggttcatgtgacggatgcacgtggtgaggcttatgatggacaacacgttactgctctaacttggtcggagactgagctaggttatacgtgggtaggtcggattggtaatgttagtgtaccgtgtaaaactcggttgtctagtacagagtgttccttgtataccaatggaacaactgatatgaacttgactacatgtaactactggattcgattaaatcaacgttatcggagagtataatggcaggtaactttactgctggtgttaatacaggtatgcaaggcgcacagcttggggctaactttggcccacaaggtgcggtgatcggtggtattgctggcttcgcgttagggtttcaaacacctgactatgagaagattgctcgtgagaagtacaactcggaggtattaaagaactttgctaaaagtctatttgacacacgtaaggttcaaaatatcgagaatatgcgtacagcacaggcacttgcagcttaccaagataatctacgggtacaaggaagttcctacaacgcacagtatggtgcagccgatatgattggtagttctactacagctttaaaacaagctatggactttcaaacacaagaggctaagcgtggtgtgttgatcaattgggaaacacaggtagataatatgaataccagtattgatgctatggcaaatcaatctatggcaggcctacgtaggacaaagggcgatactcgtcaaatggactatgctggactagttaaaacaggtttagacttgtatggtcagtaccgtaacacattcaataacccgaatacatctaccactcaactaggtatcaataagattcctgataatatgtctgactttggtagctatggtaaatcaggttctatgggtggtttcggaggtagcggatcattatttggataatataggagaacatcatgccgactatggtacagtcaccagacttaatcacaccgacaatcagtcgtgaacaagctattgatcgtcctgttgaacaagacgggttaagtacatttctacaggatgttctacctaaagttaaagagggttacgatcaatatcaaaaagagaatcaagatcattatatcgcattaggtatgaatgatgaactcaaccagatcacacgtgatgtatcttggttagactctcgtaactatgagcaaggtaaggaatttcagaaggtatctagtactcaggaagcacaaaagaaagccttcactgatacagttacccgtatggcgcgtgaaggtaagaatgcagatgaaattttcgatgcaggtcgtgaatacctcacagcttatacaaactcagtttataatagtcaattgagtcctgatttaaaaaacgccttatatgaggctggtattaaagagaataccatctatcagaaattgattaccaaaacaatgtctgctgttgcagaggaacgtgaacaattcgatgctcagactcgtgtagcgggtttatatcaaactgttagtactggtctagacgatcaagaaattaatgatgcattagaggctcacgtgcgtaaggcgtatgctgctaagattgcagtaggtgttgatcctaaagaagctatgaatgcagcacagaatgaaatctcggctacatttaaattctggaatggtcagattgatccaagttcgcctaatgcctcagagcaggttaataacctacgtcgtgttatggatgttgcagctaaagaaggtatcttgagttttaatacccttggtgacattcagaatgatatgaataaaatgcgagatggtattttagagtacaatggtgttcaggctggtaataccctagatgaaatgatgtggggtattgagtctggtcagaaacagtactcacatgctgaggttgaacgtcagttgacatacgttaaccagctagagacagacggtagtattacacctgcacgcgctgcacagctacgccgtgacttacagaactttggtagcactcaatatcaaaaactacttacaggtgaaatggatcctgctcagcttgtagctaataatgtatccctacaagagtttacattcttaggtaaaggcggtgaggaagcttatagtaatcaactagtacgttattatgaaggtgctaacaatggtaatcctgtagcatcaggtcaacaaatgattcaacacggtttgaaaggtgatccacatggtgagcgtttagatcatcttgttcaatatggtactcagaagttagcttcacagttcacatcattcttgagtatgacacctgaaatggcagctaagcaagagaactttcaaaatgctcaagttgcatttaacagcttacgtgacacgtataataaactacgtgcccaaggtagtcctttaagtactcaaattcttgctggtattccagaggaacaacgtggtattgtacagcaattatttactaatggtggtagtatgttcagtgctaaccaagcattagctaaccctgtgcaaactaaccgtaaagtggctaatgtagttgagggtactaagaacattaaatgggatacggaaggtgtgggtaacaaactatttaaccgtggttctggtggtggctctagactgtttaaaggtatctctaaagatgttcaaagcacttatgtagatacaatgcaaatgatctatgaggattctaagtacgagttagcgggtgctagtacaagtgctgaccctgcgttacttgtggcttctgctactagtttaggtatgcatgttaaatcacctgcgggttataatgatgctttacttacagcgcgagcagctaaggcttatcgtaatgttacctataagggtgttactctatcaggtgactacatcggtgctgctgcggatagtatccgtgaacagattgctaagaacgctaatacagacgctagtaacgttatgatctatagtaatgctagtggtagtcaaatttatgtgcagccattgaagaaagatggctccgtgcaaaaggacactgctggtcgtactatgactgtagctttttcacaggctcaattcacacaacgtatgaaagaagcttatgataaggatgcatcacgttacaagaagaacaccagtgtatttactactattggtactgctgcacgtgagacgttcagtggtcagctaggttctgatactcgtaattacagacagaacgttcaagagtggaataagacattcacagttaataagaatggtacattaggtaatactgttatcaatggtaatatccgtgcccaaatccctgctatgacagctgtgccgtttaacggtaacgtaacgttagctaatcattggcagaactaccttaataactatgaagggtttaagactactgcgggcgttgtgaaaggtactggtactgataaagatggtttcatcattggcaatggtatcaacttatatgcacatccaaaatggaaacaacgtgctatcgctgcacaaggtaatcctcaagcgattctgaatctacaagcagagttcatggcagagaacatgcgtgaccaacaatcggtagctaagaaattaggtatccctgttgcaactgcatctccgtacaactcacgctttgtatccgctcagattctacttgctgattataaatggcacaatggtaactatagtgttatcagtgatattatgtcacaacctaactactcatccgcattagctaagatgcgtaagtctgctgcatacactcatgcaggggatgatcatcgtcgtaatgtggcacgtagaaacatgttacgtgattactatatggcaattggtaaactttaataatggagggctgttatggctagtaaatatggtgttggtaaagatatccgtactctagaggctgtgcagcctgatattccagaaaatattggaacaggtaaaggtaaaaaattaattggtacgcttgcagcggattcttataaaccgctggggcgtgctaatactgctgatttgttagtccctgagcaacaactacaggatgctaaagcacgtgaagaggctagtctgttagagacggttactgctgctgttgcacctactgcacgcgattggggtaatgctatctatgaatcttataagttcacacctgatgtattctaccgccccgatgcagatgcacaagagttcttcaatgaatatcaaatcactaatcaagatgaagtagcttatattaatgctgctaactcttacgaggatatggagtttcgtaaacgtcgcattctagatcgtcgtgatgatcagcaaaagattgcagacaatcctattacaggtattgtagctagtatgttcgatattgatgctgctgctatgttagtacctgctgtaggtgaagtagctggtgctgctaaatttggacgtattgctcaacgtactgctaatgcctctatcggtgctggtggtgcttacgctattaactctgctttagaggataagagtacccgtacacaaacagagcgtgacttagacagcttaacctttggtctagttggtttcatgtcgcctatcaaatacaaacctaaagagctagacgctgctatcactaaagagatggcagatgtagctgctcagaatactgctaaggcagatgaggtcggttccgttggtacaactaacttatttaatcatcaaatgaaagtacctatctctcaaccaattgacacatctaagttgatggtgcctgattgggctaagtcaaataagactgtagctgctctgcaatctagcgctgactatatgtaccacatcactcatggtgacatggataacgtagtaaacaagattctagcagcgccacgtacacaaggtgataacgtaccttatgctactgcacctgtacaagctttacttgaggctaagttaacatctgttgagcaagctattgagaaggctgctattgctcttaaagatactagacctaatcgcgggtttggtcgtaaagagcatacacaggctcagtatgaagtaggtgaacaattcgggcaagcaatgcaacgtcttgatcaaactgtggtggatcgtctagatgctggtcttaaagtaactaaagaggacattgccgctcttattgatgaacaagccatcccaaatgaaattaaggatattcaacgtgcttatgttaattcgggttttgccgaagaagcattatcacgtgctaaacaagtaggtttattagagaacttggacgacgctgctgcactgcactcccgtagtacgtatatgcctgtaaaacactcatgggaacgtatgaataatcttatgaagtcaggtgtaactcgtgatgagattgctacctttattggtaaacagatcaagcagatgtaccctgactttgataaggcactagctaaatcgcagaaggctaagttcgtcttgacagagaagcaactaggtttgaacttcattgagaaccaagagaaattagctctcggcttatcagaggtacagactgctggtttaactaaagatcaaatgatcacactcttacgtaagtctggtgtggatgatgagaaccttaaccgtatcgcggatgttatctataaaggtacacaagatgcaggtacaggtgttgctaaaccattccgtaaacgtatgcgttgggattttaatgctgtcggtgaatcggcaagcggtagacaattcacaatgggtgatttagtcgatggtaatgcgtatatgaatttaactgattatacacgtactatgtctaagcgtattggtcttgcccagtatggtttaaaaaccactaatgacttagaccaagctttagcagagactatgaagaatttacctaagaatgtatctgtagaagaggctagacgtttcctacagaatgtacgcgctcaagctttaggtcatcctatgggtgaggctgttcctgaaacagttcgttcattgaatactattgcaggtgctacattcctatctaactcaggtttatataatacagtagacttggtgactcaggttgctaagatgggcctattgcgtacactacctgagattaagaaaggtttaggtaatatcattaaccctatgaagaagatgaccaagagtgaagctactgacctttatgacgtattaacaggtatgttaagtactgacggtcgttggagaaacatcactacacgctatgctgatgactttgaggttacaagtggtatccatgaaggtattcagtattatggtcaaagtactcgcttcttaaacctatcggaatatgttaagcgttttcagatcggccttattggtggtacattcattagtgcatttaagaatgcagctaaaggtagtgctaaagatatcgcatggttacgtaatgatatgaagttctctgatgaattagtgcgtggtgtccaagagcaatacaagctacatggtggtgctattgatctatgggataataacattcgtatggctatggaacagaaagtcttttatgaggctgacaacctagcacatactatccgtgctggtgaaatccccgcatttatggagcatagctctgtaggtaagatcatcttcccgtttatgtcttttgcattcgctatgcagcaaaaggtactacgtaacacttatcaacgtgatggtggtgctggtattgctatgttagctgctgtgcagttacctactgctgttttagtgggtatggctaaaaatgtgaaaaatggtaaggaacctgatgaggatttagctaagaactctgttaatgctttaagtatgttaggttcatttagttatcctttagagatcatcattaatggtggtttaaatagttccagtgcgactttagcacctattgccaatgttgctacattaggtaagaaagctgctgagggtaatctagatatgcgtgctattaaaggtgcgacacctctaggtagctttactggactagatttatttattacagctatcgaggaataatatggcaattaatcagaaacaatcatactcggagtacgatgtaagtactccacaaggagacttcgctattggttttgaagactataacgaaggtgagaaggatcgtatcaatgtgactgttgatggtgatgatgctgctagtaaaggttatacagttctacgtaagaacgctttaactattgcaatgacaccatttgtgccgtctggtattgtacgcctcactcgtgaaacaaacattgatactacattctacaaatttacagcaggtgctatctttgatgctgctaacgtagatgctaactttacacaagttctacactctcaacaggaagtacgtgatcgtcaatcctacgtagagggtagagtactacctttagtaactggattagaagatgcacttgctaaggcagatgaggctagtaaggctgctcaggaagctgctgaggctgcggcagaggctgcacaacaaactcgtagcgctgacaaggttatcgatgctagtgggttaactcagcaagatattaacaaccgcctagcaattacatatccaactgcggtaggtttagttggtaagcctaacttaaaggatgcagatgtagtttatgttcagagttacagtaacatctttgatggtggtgatggttattatcgcgtgtctgcggatactactactgtagccgatggagcctatgtaattcgtattaaccctaacttaattgcaacaatgcttaatactacaggtagtgtagacgtagctcgttttggtgctgtgatgaatgcggacgtaggaccgttcattgagaaagcatttaagtacttccgtgatgtatgtttaactaaaccctataaactgaacactgtagttggtatccctgatcagaacaactatgctaagaacgtttattatttacgtggttttggtgatccagagattacagtggattgtcctagtgctgtattcacatcggctgctgcaaagttagacccaaatagtgtagctaataagtttacagctaagcttgatgtgtctaatattagtttcattggtacaactgtagctaattctgtagtatttaatggtgatcgactttacaatattaacgtacaccacaataactttaagggtaatattactatcttcaaggcgtatgttaaacgtgaagccgaacgtcagtatactcaaagtatctctattaatcataaccacctagcaaatgtatatcgcgtcattgagacagacaaggcttataatctagacttctcttacaatatgtgtgaagcttgtatcggtggtatttatgtaggtgtaaatgcgccgtgggaccctaataatatctcattaactatccaccgtaatttgtgggaaggtagtggtatgttattgaaaaccaatggcggcattattggcggtactatctcagctaactactttgagaataacacatttcatgatgcaggtattgagaaatgccttatcagtattaatcgtactggtgcaggttcaggttacgctagtggtttagttgtattgggtaatacgttctcaggtaataattccatccctgatttcgtagatgtacgttataacaaccagagtaccgagtcttctgctaccagtaagacagcgaatgttaaacccatagtattcattagtaactggtcaaatagttcacttatgactaactttgcaggtgccctgcttatcaacaaccgttgtaataaccgtaatactatgtttaatgcttacagcccgcaagagggccgtgtaacatttgcatcagggtacttagataaaacgttagctagtatgttagcaggtaatcaattgaacttattaacgttcgatacacgaccatgcttcactgctggttatatcaacacgaactttaagactcggtttgatgtgacagtattgtttaagactgctggtggtattaatacagctagttgcagttttggcttagatgtatttgtgtatacaccgctaggtgcaggtgcgccgcctaagtctaatcttaaagcagttatgtcaggctttatgcagtcagacactaatgatattattagtgtagctgctaacgagactatgaaaactgttattgcaacacctgctatcacagtagtaaataacggcgacggtacttatggtattcgcttaggtaactttactaatgcatcctcacctaattggggtgctatcactactgcgcgtattgagtatacttaccaaggtacactcattgcatcgcatacttcaacatactcgactgctaacttattgacagtcgcataaggaggttacatgaacatcgtagatcaaatctactttggtttggtctatgtgtggtcaagcctagataaattaatcatgggtgctgctgctacggcttttgtagtggcactcctacgtacacgtaaacgtgacggtaaagcttcatggattgaggctactttatgtggtatctttgctactattgctttagtagggtttagctttattgctccaatcctagtaggtattctagcaggtatggggattacaattaatcttcctgtagaccctagtgcaggtatcgctggtattgtcgctgggtttatcggttggtatggtacagaacgtactatcgaatttgtggaagataacttaggaggtgataagaatgggtaagttcatcacccttgatgagattacgtccaaggctaaggagtacggtatagaaacagccgcactccgtgctgttatggatgttgagtgtaaaggtcatggctttaattccgatggtgcacctgttatactgtttgaacgtcataaattctattatggcctacaggctatcaattggataactaaatcgaaggaatggtataaactgtaccctgacatttgtaaccctagttggggcggttatggtaaagagtcacaacaacacgaacgtctacgtagagcctctgctctaaatcgtgatgtggcccttgaatccgcatcatggggtttagggcaggtgctaggtgagaactggaaagaccttggctacaagagcttacaggacttcattaacgctatgtacaaagacgaagtatctcagcttgatgctatgtgtcggttcattaaacataatggtctaatcaagcacatccagtctaagtcgtgggcaaagttcgcgcgtgcttataatgggcctaagtatgcggataataagtatgatactaagcttgctgctgcttataagaagttcggaggtatctaatggcaaaacgtaatagtgcaagtgtaagtctaatgaacgaattacatgcagctattgcaagttacatgttagctcgtctaaaagcgagtattcctgatcctaatgcaccagtggagtatgatgaagagacaggtgaagaaatccctgctttcttcatcccactagctgcatctgaattacaggttatggtaacgttcttgaataacaacaagattactgctacacctgatgtggaacacatggctgctttagcaaatgagttcaagggtgatttagaagctgctcgtaaagagcgtgctgaaagtattactaaagtaaatgagaatgatgcattcatggcatcgttattatcataggagttattatgggccgagtatccagaattaccgagcaaactaaacgccgtttagctatgttgcttgaacgctgtaatcgctataaggataatcctgtagctattccagccgaagaacgcgaagaactatctatgatgttcgctgcgacatttaaaggctttgctgagtttgctgaattaggtatgaagtatctcggctttgacctctctgaaatccaagatgatatcgcagagtacatgcagtacggcccagctaagaagatggtacaggctcaacgtggtcaagctaagtctaccttagctgcactgtattgtatctggcgattgattcagaatccaactgcacgtattttaattgtatctggtggtgaacgtcaagcatcggatgtagctttacttattatccgtattattatgcaatggggtatactatgttggatgcgtcctgatacttctaagggtgatagaacaagtgctagcgcatttgatattcattactctcttaaaggtattgataaatctgctagtgtatcttgtgttggtattacagctaacttacaaggtatgcgtgctgacttcatccttgctgatgatattgagacacaacgtaactctatgactcaaacagagcgtgagaagttactattattaactaaagaatttgctgctatctgtattacaggtgagatcatgtacttaggtacgccgcagactaaagactctgtgtatcgctctctacctgctcgtggttacgacgttcgtgtctggtgtggtcgttaccctaccgatgaagaacttgagcgctacggggctggtgtacaggttgcaccgcttattatgaaccgattacttgctgacccttcattacaaactggtggtggtgtcgatggtactcgtggtcaagcaaccgaccctgcacatattaatgagcttatcttgcaagagaaagagcttgagtacggccccgaagggttctcactacagtacatgcttgatacaacgctctcagatgctcttagaacgaagattaagatttctgatatgattgtgctggattgtggttatgatcgcgtaccagagcaattagagtggttaggtgcgatgaataacacctttaaagaacacacggagtatagcaaagacttcactatgtataatgctgtaggtgtatcggatatcctaatcccatttgaacataaactaatgactcttgaccctgctggttcagggggcgatgaagtgtctttcgctatcggtggtgctactaactcttatatctatttattaggtatgggtggtttcgctggtggtatgactgaacataacatcgataagattctattgaagatgattcacacgggtacgaaggttctagatgttgaacagaacatgggccatggtactgtgactatgttgattcaatctcaattaacaaacctgattaacctgcttaaatacaatgaccctaaagctgatgagttcattcagaaatctggtatgtcccgtaatgaattactacctttacttactggtatcggtattactcagtactatgtgactacacagaaagagaagcgtattattaatactattagtccagtgactcgccgtcataagctagttatatctaagaactgtatcattgaagatcatgagtactgtcaaccacatccagtggataaacgtaaacagttcgcagggttgtaccaattaggtaacatcacttatgatcgtaatagtttagtccatgatgaccgagctgactgtgtacaacgtattgtagaggtgttgaagggacacttaactaaagacgctgataaggctgctcagaagcgcgtagagaacgatatcgctgagtggagacgtaaccctatgggttattcagaagacgtcttaaaacgcatggggcaaggttctagaggccgtccacgtgttataactaatcgtagaggtcgtagatgagtccagaagaaatccgcagacgcttggatacaatcaccgagcgtattgctaatgctgtaatgattgttaacttaattaaggagaaatctaaatgagtactaaacgagaagtagttgtacaagctgtagataacgctgtaagcgtcgctaaggctgttaatgctaatgctgagtacaaacataaggacaaggtcactaaaggccttgaattagctggtaacgtcctacagctattgaaattgtttaagtaaggaggttgctatggatggctttgaaagtacagttaaggttggtgttaagcatactcagtatgaggagttacgtgaccttaaacaacgtggtgagacattcgacgatgtgattcgccgtttactagatgctcacaagagtctcaagagtattggcttattagactaggagattagtatggttaatagtgcagtggtagcattagacgagtgtatttagtatcatgttgccttagattatttagatggtaagtacgttagctttttatctacgtatgtggtatggctgtgaggattactggacacagagtggaagttacctgtacgattaactagattaccttctcagatgtgagtactaacttgaatttatattttgggttagatttctgagagggtgtctcccactccaccgcagccgacttccccgtataccttgggtttgtatgaatctctagggaactagctagggtatgcttatcagttccttatcagatacacagagatacgatgcaatgcatcagtacatcggagaacatcttatcagtacgggtagagtacagcttatcagatagtatgtcaatactcttagagaattatttcagtatttatttatagttctgtttgagatacttctatacttgagtgtgcttgccttttattgtcttcatatctatatctatgtgtatacctatctagatactcttatcattctatcttatctatatctcttagtacttcttatcgatatctcttatcttatctatatagttctcttagtagtatctatagtattactcttatagttatatctatttatatctatatagttatctcttattgttctctctttatgttctttattctttattcttatacgtgtagcattcaatattattcattaatatcaataacttaaaataatagaatcgtaagttttcccgtagttatgtaaacggttgatacaaaagtattctcttatatattaataacttagcttaatttaggtaacattgtgtaactagatagaactttcttcaattatttatcaaataagtattgacacgttatttaaaccattatactatgcactcataccaagcaacgacgagttactaggttactccttaaagtacttattcagatagttctaataagtgtatcaatcgacaaggtaatacactatgaaaactttaacacatcatatagcagttcaatgtacttgtggtgctactggtcagactggcgatttcttggtagatattgagcacttcaagttaacgggtgaattaatagctttagatggtatggtctttcgatctttaaccgctttatatgcttatgctaatacatatggtttaccaactaagcggttaaatactccgatagtatatcagtcataaggctgatacacttattagaattaaatgaataaataatttaaataaagtattgacagattaaatcgaaagaattaagatgcacaacataacgagagattagctagatcactagcaagcttgatgctctaacaggttgatagctctaaggtgttaaggttatgatcttcctagtagatgatactagggtattatttaaagccattaatttaaatccgagtgtgtgacgatgtacatcttgtatgtataagcacatgtacggttgaagtgtagtgataggctcgtgggatgtactcgcaagttaatttcatatactgcacgtaaagctatgatgaatctcttagagtttatatttagctaggttggtttggatgctatgcacatcgacctagcgctaatgtaatctcggtgattacttccatcaagtccataaggatactagtatgaaattacttcttaatgttcaagagatcaacaaagcaatcgagtctatcgctaaccgtggtaagaaacttgatcatgatattcatgtagctggtgtgtcagtgttaaagcatgtcgctgaacatggtgatacaactttgcttgataagctcgttaatgcaatgcctaaaggcgcacgtaaaggtgcattctgtgagtgggcactagcgttcggtaatgtacgtatgcttgaccgttctaatgaagctgataagttagctatcgaacaaggtcgcttattcgctaaggataagactaaggaatacaatgaagttgaagctatggctaaagcttggtatgactttaaacctgaacctgatttactgactacgtttgatgctgctcaagctgttaagtctttgttgaagaagtacaagacagcactcgataatggtgcagagatcaagggcggtgatgttgctatgcagcagcttaaatcgtttatgcaaacacttaacacaatggatgagcaagtatgaaggtaaaggtgcgtaataaattcgctgcggctactagcattaactacaaaggtcattatgtggtacgtaatggtaatggtacattgactttaggtgctgaacatataaccgaagaacaggctgctgttcttaatttacaagagttttctaaggtacgtgagtggttaggtcctagttattcggtggagattattgtatgattaaacgtgttgatcctatattaggcagcttagtgcgttgtccgttctgtaagaaagtttatacgcagtgtcgctgcttatggtagcgtacattattcctcgcttattgctcactgtagccattctgattgcagtgggtatgattacactatctggatttaatcctcgcttatacgagcgtatacagccacacatgtggtgtattagtattgcattaaccatgatagggatgtggtatctatgatagatgctccgctgtacttgcaaatcattatgttcatagcatgcctaagtgtaggtgtgcttctctctttcttctgttacaatggtgactgatatgacagacacaaaagatcaaggttatgaccttggcgatgaaaacttattatctgtggctaagctagctatgcgtcgtggtgagtacctactatctgcgtgggatcagtttgcagctatggatatagtggacggtctaaaccgcatacctagtgctgatggtttaattgtgtaccttaaacatggtttatgtactaatataaggtttgaaattagtcctatggctaaccacagattacgtggttcacaggcgttggatagcttattagaactagcctatcctcagtgggatggttactcaggtaattcaacctaccctgtagatggctactatgagtatgaggggtatactgaggatggtgaacacgatgcaggtatgtatcatgagcctaatctattccgtaaccctaaacgtaaagaacttcttacgtggttagtaacctctttccttcctgaatacatcaagcattggagtgctgaataatgttaatcgttcctaaagtaaatcctaacgtcactgtcacattgaacatcggcttaggcgaatcaatcgcatggggtaaatacaagaaagagaatgcagagcatggccctgtacaatctcttgtcgatatccttgacacaccgcatcgtgtagcacgtatcttagaacgtattcaaggtatggcgtacaatccgaatcagcaccatcacgggccacatgtggcacataatagctatggtattgattatggtcatcatgtacttccaaatgttaattggcgtactgtgcaagttggtaatgaaatgacactggtggtgaagtttgaagcggttgctcgtgacattatcggtcaagtgttctaccttgcagaagaactcaaacaagactgcattgctgtatggattcataacgataccaatggcggtatcggtcagttgattggtcgctacaactatgtgtggtctggtgggtacttcaaccctgagtactttgttcacttggaggtatagcatgttcaaggaatacaactactgcggtcagtgtcgagttaattatatcaactgtcattgtcctacgcattatcctgaacgtaataaggatgatcaccacctatgaaaaagctaggtttaattgttgtgtatacggctgcttatgcagccatctctttagtccaatggttacaggatgataaataatgtttgtacttaaatcaacacatcagaaagcgcttgatgaaatcaaatctttacgtgcccaactagatgctgctgctaaaactaaacgtgagttgcaagaacgtatagactcagtacgtaaagtacgtgatacggttataaaatataatgcttgtttaactgcattatgtcagtacctacccgagggtgtttaccgcattgactatggagcagaacgtcgtagttgcagtactctccgtaaaacatctgtggtgtcatacagcacatccgtgacggtagatcataaagctgctaagatgaccaatcgcaactatacaatccaacatgaacctctagcacggacatgtaaacaggctgaattaacagcgcgcctagttgcccttgaagtccaatataatattattaatcgtgatatagttgtattggatcaaaccattaaactggctcaagcgctgtatgatgtacctaccgtatgtcattcggtgactaaacgtagcgtattatctaagcaacgtaaacgtattaaacacgagttggacttggttaaagtcgagctaaataacttatagtctgtactcgcaaatcaatttcgcatttaatagatgtaggtggtaacacatgaaatactatgataactctcaccctgaattacaagggtataaacagtttattcctgaaaatcctaatcaatggttcgacttaatgtctgctaaccgtgctgtgtttatacgtgaggataagcgtgtagatgcagatgtttgggatatgattgtacagcatcttactggcgtgtcttataaacctcacagatatggtgaaggtaaacgtcactacacagagttccaattactccaagggcatcgtaaacttggtgagggttattgtagtcgtgtttatacacacccaaccaaccctgaacgtgtggttaagttcttcgagcgttaccatgaagatgtgtgctgttacgagtacttacgtatgtgtgtacaaggtaagctaccagtgtttgattggctacctgaagtacatagtctagcatgtatcaaagttcttatccgtgaagatgataaggtgcgtatcattacttatggtgtggctgtgttccctagatatgacccaatagaatcagactatgagaagcaaaaccgattcgttcaagatggtattaatgctgagttcaagaaatatgtgcatccatatctaccgcatgcgcgtattgacctacattggggtaatatcatgtgggatcgtagacttaatcaatatgtagctactgatcctgtaatcaattcagcacctgtagaaacacatgtacaaactattgattggttccctaaagaaattagtgctaagtactcaggtgcgaccgcatgttcacgtcctaatgtaagtactcgaatgactacgcaggattatgcaggtaatacaacgcacccactagcaccacattgggctaaaatacgtgaacacgtgatgcaggtacaacattcagaagcagcgcgattagagcgtgcttggagagtgcatagacctgtactagttgaccatgctatgtttgtgcgtgagttgatgcggtgtcctaaaagccgtatgttccttagtttaaagacacctaaaccaaggctacctcaatccgctaagtacaaagtacagcgtaaggtggttaatgaacgcttaccacaaggtaagttcttgaataatttaagacaggagttacgacatggtcgtgtatggtaatgtaatctttgagcgcgatttagcgcagaccatgtataaacgtatgagttcacgactagcagatggtgtacgccgttgctgtatggttgatgaacatacattgtactttgaatcagaagtatctgacagactaagtcgtaagaagttcaataacatcctcacaggtcaacgtattgcgccgtacagcgagattaagtacccgaaggtaggtgagcatacacttatgtctgatcaagccatagcagaagctaaggcgattctaagcagtgaaacacgtacacgtagttgaggttattatgtggattttaataatgagtattgtggtgggttcttatagaggtgtgtctgcaaccacacaggagttcactagtaaagaacgttgtatggtagctgctcaaatggcactggataagaaaatgggaggtggggataactccaatagactcaccgctatatgtgtacctaaataagcttatagatagcagcattcaaacggatgctgttagtgtataagtttcctttcgctactcaatggagtatattatgtcattagctaaacaattcaacgctgctggtatccgtggttctaaacctaagtctgataaaggttggaccttcaaggctcagaaagcttatgtacgtaaccgctttgaaaatgtagagcgtgttattgcacctgtgtataaccacaaggttgagcaggtagcccgtgccatcatcgttgaaacacctttagcatctttgaatgttgtggcgcagggttcatcacttcattatgattactcacctgacacattagtccgtatcggtaagctaactcgtaaaggtgcaacgttctctgcggattctaactcagcattagctattcttggcttgaatggtgctgctgtgctgtactggttaggtggtttacgtattaacattgatgaacaacaatacgaagtcatcactaatgatggtgaatacatctatgctactgtaggtattatcttacaattggcccgtgattgtgtgttcaaccgtgatgctgtacttgcaaacttccaaggagctaaacgtgtccgcgccaaataatatctttcataagggtatgcgtgtcatagtaactaaagcagatcgtgacgatgtacgtctaggtctgcatggtgataccattgccactgttgtaggtgtacatc

SEQ ID NO: 761 - protein, 27 aa, Unknown
  Description of Unknown: Undetermined Phage F1245/05 peptide
GFDVTIEPIAQDKYFLVDSKQIREYRG

SEQ ID NO: 762 - protein, 165 aa, Unknown
  Description of Unknown: Undetermined Phage F1245/05 polypeptide
MFLKLFIAIYTEQHLNAAKNELERLGYKCTSDFHSALDQPVTHITTYPNGTYTIWTLDLDMCRRLARANTTVRVINLRQLRGVHRRLRTSFSQDNHSKLEIVPVRSVNIFPELEKLSPLETEAMQAAIKWSSPKVPTPNVFFKLWYNTAISWTKAIVNRLVRHFK

SEQ ID NO: 763 - protein, 57 aa, Unknown
  Description of Unknown: Undetermined Phage F1245/05 polypeptide
VSKIKMNEYRGKPPYSMDDLAEDPQLERRYIQRERRNHVKERDLDRRNKRQAKRNGY

SEQ ID NO: 764 - protein, 103 aa, Unknown
  Description of Unknown: Undetermined Phage F1245/05 polypeptide
LIDVTNAKPSETGIRIPVRIKIKSVKHYCKVVQCLKDYGVQVPAELADELNLRRNKEYCKRAWVWIGTNDVAWVFGSYKIVKFAKVMTRKEYVTWRQSTALNG

SEQ ID NO: 765 - protein, 255 aa, Unknown
  Description of Unknown: Undetermined Phage F1245/05 polypeptide
VATIHSSEWLDQAKKVPVGQKRRVYHGAEMTPAMDVWNNEDSWSCYCHRCHAGGKVYKQFLQRVNPEQPVYRKYLNTKDLITIDELYSTDKLKYKRLMKLLHDKGMSMITIAALKPMYNKVDDRLVFRFKGVDIGRDCTGLHGAKWLVYHSDNPSGYVYLQGKNPYCTREPVILCEDLFSAQKVRYYTGWSSLFLMGTNFKDETAHFLMSRLPVIATDGDAAGWAARKVIRTRCEMFNIPVQSVDVPVGLDPKDM

SEQ ID NO: 766 - protein, 104 aa, Unknown
  Description of Unknown: Undetermined Phage F1245/05 polypeptide
MGSKYNRIKFRVSRRSEWLLGIQHAENNGFPVGPDHEWKIERYRGGKALINVRLDYNDTGLNPESWYSTPIGTALWVDTLGDFKHAVNCFCHDGYLDVDNLKVV

SEQ ID NO: 767 - protein, 83 aa, Unknown
  Description of Unknown: Undetermined Phage F1245/05 polypeptide
MAIIRIPIRTEAEANQFISIVKSQGLALPDLDVVHRLGLATARVGSDACVWTGIEQYIGTRHDFPHSDETVTVNQLYKRLQER

SEQ ID NO: 768 - protein, 255 aa, Unknown
  Description of Unknown: Undetermined Phage F1245/05 polypeptide
MSDLNLLRVMMERKQFTGSFKSIPMDLYDPHTVTMLGWFKLYYKSYEDHERIDVDTLGSLIKLKTKPHEDKAKRDAQTALMNEMLRNLKQPLPLDIRATTLNALEERRLSAEAAMICRKYDEGEEIDVIFELNKLAIATKQRVELQTHAAWCDTDVWELIQADADDAGYVFDFLPEEFYTNIKGVNEGNNIGVAAPTDKGKTSFLVRVAVSFAKQRFKRMQNDDSMKFRPVLYLVNEGTAEVITPRVYQTALEIN

SEQ ID NO: 769 - protein, 255 aa, Unknown
  Description of Unknown: Undetermined Phage F1245/05 polypeptide
MKFKRGDIVKAVMTGGCYSITSGQMYEVLDVRAGGNINIKPSRGPCNWSKSHRFELVRSKEDTVGVQPTMNIKLYDTVVRTTISHHLKIGEKYTVTTLYPQSNHIAVEGFPNMRFSAADFIVVPDLEDRPKSLGFDKVCAALKDGTPLQYFFNEKWVDVVRPDSISIGMINKSIWRYAINTIDYYGQEIPAPIKQYPSTGLVYGISLTKHEVYKCNVNKRLGQLHYKTAEDAHAVLTTILAPFGITPKALDFSLT

SEQ ID NO: 770 - protein, 255 aa, Unknown
  Description of Unknown: Undetermined Phage F1245/05 polypeptide
MSLREQVRKYLDVTKSPVQLVKHMDEVLEKNIKYPLIAQHKYDGVYVLVAVTDGIPTLYSRTGKECFEGLYNTDFVMSLNGITDGIYIGELCNSKFSLEVFNGLVSTNRKKSWEDSESQDTIQLLEEHTFIMFHDYIFHNCLLEGHCKLPYWARYDLLRKRLRVAELLDYLVVSDEVKSREDADAYAQLIIDVGGEGAVFKHPAEEWVAGHKGYRTMKIVRDLVLDLLCVGVEYGKGKREGQIAKLKFSYKGSVF

SEQ ID NO: 771 - protein, 255 aa, Unknown
  Description of Unknown: Undetermined Phage F1245/05 polypeptide
MSQINWLVLDFEVQNHDHYGSLASPHHPDNYLVATGWSEDGNSVQAEYHHSKDEQYCKRFADALSRAKNLVAHNLTFELHWLMKVYPNDLQAFINRGGRFFCTQYAEYILSNQIEMYPNLEDTARKYGGSPKVDAVKLLWEQGVLTADIDQALLMTYLAADGKNEWSNPEDPSFQGDVANTRRACFAQVAELRKRGMMGMFKERMDSLLFNAWATYNGLYVDLPTAQRNQAEQEKQIAQIKSDILGMLPNDLPDD

SEQ ID NO: 772 - protein, 255 aa, Unknown
  Description of Unknown: Undetermined Phage F1245/05 polypeptide
MTFNALELVQGIDTSTLADMTDTTTGGGSKRGLLPAGFAFAVFSSYIEYGKQPQMFDGKKKDPALEFRLGFHIVGGVGTNLAGEDEDYVQDGFLPTISTWDTAQSRNEKSKAVKYFNAINIVPKGTHFIQKLGTMYLVEVKVTKNKKTGKDQNEFDFTSLQQARDQATRKAYTSYTNAAGIEVAMGELKPEDYKVFLWNRPTNVTIEQYQAMWDSIEIKGETEIKDAAGNVTGKRSKNFLQEKCQRALDFEGSSL

SEQ ID NO: 773 - protein, 115 aa, Unknown
  Description of Unknown: Undetermined Phage F1245/05 polypeptide
MEDTNRATGRTTRMILKAVEYLIKHPKKTVRIVCYNNYGCVWMADYIKSIVSDRLWQRIELATYQHWQCSGIGKRDDYFFDHHCFYHEVYNLNNRLKEVKAQLERAEKDYRKYDA

SEQ ID NO: 774 - protein, 255 aa, Unknown
  Description of Unknown: Undetermined Phage F1245/05 polypeptide
MMPNLSHFGLDAQTLSDQSTFKPSKGDSNILLYDGDGGCYQSAAGAAKQETAMRRFERDILENMFLAGCTKARVHLTPSGCFKNGRHLLLGAKKYQDNRSNKNKPQHLEYLRSPASVEYFKDHEDIEIILNYRVEADDALMMDHYRYHNGILVSPDKDLNISPFKSYKAELGKHLVLPEGDRYGWIDREFWLTPSQKPSSKMIGKGTKFFLAQLLMGDTADNVKGILKLNGKLCGESAAFDALNPITDEHEAVNF

SEQ ID NO: 775 - protein, 189 aa, Unknown
  Description of Unknown: Undetermined Phage F1245/05 polypeptide
MNYNETLKRAEFAVQILNAAGYDAHIVGGALRVQALGGTTNDIDIAVITTFKEGELLNKDVNILLDRLGFNFKLQHQNSDYTDDSDLFIADWCSGDINLIAYNRSVTPTVRDLVNTFDLSINMFYKENGVLKNDVWLQGVCAVVLNPNRLGHNPKLNERIARFKQEYDHLDWSPVDKQLAIEEHMNAIL

SEQ ID NO: 776 - protein, 149 aa, Unknown
  Description of Unknown: Undetermined Phage F1245/05 polypeptide
MPSSRPLQRISRQQLKGIMIALYQRQGNKCAICGKPIDFSITGHKANYAVDHNHETGEIRGTLHKSCNSAEGKVTNAAGRWGCKSTDYNDVIPWLESLINYLKTAHRNGTGMMYPDHKTPEQQKDAANLKRRKQYAAKKAAERMNASRK

SEQ ID NO: 777 - protein, 72 aa, Unknown
  Description of Unknown: Undetermined Phage F1245/05 polypeptide
MQVGSKVVCVYAGDSTLIETHGTYEVLGFSSYDGPNSHVEIGLDGRLLGSYSPKRFMTVEEVTKQTQENLND

SEQ ID NO: 778 - protein, 255 aa, Unknown
  Description of Unknown: Undetermined Phage F1245/05 polypeptide
MTKKHHALKGIKLDIMKLWWDGKSYQQIAEVVCKPYDTVYGIVQRYRDQQPPVQHTRKPTIFVIGDTQCKQGIDLAYLHYVGNYILEKRPDIIVHIGDHYDMASLSTYDKGQLSAEGRRVAEDIKAGDKGIEIIENYIARAKDYNPRKVVTLGNHEERIDRFVNHNPEFEGLIGTDKLAFANYGWEVYPFLTPANICGINFVHFVQNGMTGKPLGGTVMTRLKNVGESFVMGHQQVLDHCLRYLPLSGKAQIGVI

SEQ ID NO: 779 - protein, 58 aa, Unknown
  Description of Unknown: Undetermined Phage F1245/05 polypeptide
MIIDGTKLRCINDKGQRIVKEGSLYTAWVRDGIGIDGRIFIKEHKRFALLITRFEVVE

SEQ ID NO: 780 - protein, 217 aa, Unknown
  Description of Unknown: Undetermined Phage F1245/05 polypeptide
MKIGLIGLAGAGKDTSAVILQRVLAEQGLKFEIDRYAAPLKNAAKEVFGANFDERNVKEVDVFVDQDTMIEASFRCLRQLGFTDDEDEKASELFFEHIGFLEYLSPRLYQQLLGTEVVRAVRPSAWVDRIRRLNRNIIIPDARFENEVSDCNLLITRFQNIDKPKHPSEHLAWDLQFTGKVLPVDTININNEQGTTLELLEERIRSVVSLINFNEVV

SEQ ID NO: 781 - protein, 255 aa, Unknown
  Description of Unknown: Undetermined Phage F1245/05 polypeptide
MSLYQRQLELEEKYSTMSLVAGQQQILDAFKQGRASDVGSGRILLAKAFAASLEDVKALLDKKITGIGGKYKKLLTLASPDVLVMAVLREVVNGCASPEPVTMQQFLRSVGRIIESESMLACMDKVSPEYTSRTVQYLDSAGTKSIQHRYRTFLKGAENINLHWDQWSSEERTGTAKLILGVIYESTGLFKWKTNPHSASDSMYYLVPSEELEKHFGEVQAAARAVVKYPPMLIPPMDWQGYNEGGYITDWFRMH

SEQ ID NO: 782 - protein, 87 aa, Unknown
  Description of Unknown: Undetermined Phage F1245/05 polypeptide
MLLLIITILVVVLAVVIYKSEKETVRECFGILVEGVTLAKAKSDILKVAKVWFYTLKLTGELILVPFLTIALILFIIAGATYRAIIK

SEQ ID NO: 783 - protein, 64 aa, Unknown
  Description of Unknown: Undetermined Phage F1245/05 polypeptide
MSVDKIPNFTEDQIYWLDSIFPENTQLTTNPNEVYVKLGQRQVIQRIKQDTARKRNAYNRANGG

SEQ ID NO: 784 - protein, 102 aa, Unknown
  Description of Unknown: Undetermined Phage F1245/05 polypeptide
MGLGSFLKKSIKNSFRGGSLYKLSDKGDNMLRDVFGLNAFKDLAAGQDAQIRAMAEQNKLNTANEIQNVVQFEDDVNTGGSSDQRRRKNSAGAYARALNLNV

SEQ ID NO: 785 - protein, 255 aa, Unknown
  Description of Unknown: Undetermined Phage F1245/05 polypeptide
MAGVPELHYSLSSLFHQYRDDGLLDRIETYALWTIPSVFPRDEHTFYNANKNRTIEYDYQSIGALLVNRLASKLARSLFPANTSFFRIDSDDPRLQQIFKARKLDSVIEYENAACARLFYNASYAQLVQALRLLIITGECLLYRVNDSMRVYSLKDYVVKRNNVGEVLDIVICEHKFMEELDPAMKVKVGVVPADTTVKLYTRVQRQLINGITSWKVTQEINGRDVGTNMVYRDKLCPYIPVVWNFVNGDSYGRG

SEQ ID NO: 786 - protein, 247 aa, Unknown
  Description of Unknown: Undetermined Phage F1245/05 polypeptide
MSVENLPEGHPAREAAQPTPSVTPAVTPAPTTQPEPQVVYQNIPTYDTDSITDTAVNVFATSAGIEASRFDAALVNALNYGDEKLIDYTALTQGLKPDQAAQAKALAASVFKDRVAREQAHIQASTQKVYAVAGSAEAWKEASDAFNVSAPDHLKAIVRQMLDNGDVENAAKFVIETARGTGMVNNGTPPIQGGTGAVQQGLTQEQYYAELAKLERSAGNRSFESGQVGAEFQRLRNARILGRKQGL

SEQ ID NO: 787 - protein, 255 aa, Unknown
  Description of Unknown: Undetermined Phage F1245/05 polypeptide
MAQGTIYQPNTTRDHWGGANSDVDQHLEDYTGIVDSRFQYTQIFGALSAQRSVADRSNTVRVDRFNTSKVKGRKAGEAIESQRVTSDKLNVIVECMMYIRNPIDWMDDWTAPDRLVEMSRNNGTEFAIAYDEAHIIRLQKARSWVAPDHLKPAFSDGMFVPATLKLTTAGVADLEANASALVVAHGKIVEALIKRRVPLTDMVTLVTPTVFTELVNHPKLINKDYVESNGDFADRRVVRVNGINVVECTTFPTAP

SEQ ID NO: 788 - protein, 82 aa, Unknown
  Description of Unknown: Undetermined Phage F1245/05 polypeptide
MPQLCEAIISPALTGQALEVGDRAFEQGNTPAANDRVATLEGQVQALLALLQGQQAAGAPVAPVEVVAEEVKAPAKKATAEK

SEQ ID NO: 789 - protein, 121 aa, Unknown
  Description of Unknown: Undetermined Phage F1245/05 polypeptide
MQLDPIDYKDFYRNAGLTELEETITDLINTLDLKVHSTEAIVHDTTVNTDCNVLVNGRHVVYTDGTGNAPPTAGLYLLEQTYITTEVDQEAIAQTATRYSTGLFYTRIRRSGVWTSWNKVG

SEQ ID NO: 790 - protein, 185 aa, Unknown
  Description of Unknown: Undetermined Phage F1245/05 polypeptide
MKLLDAVNAALSYMGEHKITRVEGSNHPTVDSIVSAINRQRAALLSTGWWFNELHLTIPVETDGRIQTPARSLAIYGKSTRVSMEGEHLFNLDTGSVYFTEPVDVRIVRDIDFEDLPEYAAQYSLYVATAEVYSAELGVDNVVSVLDGLAKDAIANLRQENLRNRRYNPRRNAVRQSRYTWFRNR

SEQ ID NO: 791 - protein, 255 aa, Unknown
  Description of Unknown: Undetermined Phage F1245/05 polypeptide
MAVREGTYKSLIQGVSQQIPQERSDGQLGSQWNMLSDPVTGLRRRAGVKLHARLTNLSSSSYIRMVDILGVYYFMCIDTSTGTMKIYTYDGVLKKTYTSEYLKAVSKASIRSTVSRSSCYVVNTDKVPQKVVGATSSTFNPAHGGYFSIRAGAFSKQYTITVKWGTVTKEFSIMSDGGSADQVTPAALAQRLWALVGTDPQVTAVFDVVNDGPTVALKAKAGQNPAQLSIETGDSSTYIMVSNASRVASRNDLLG

SEQ ID NO: 792 - protein, 226 aa, Unknown
  Description of Unknown: Undetermined Phage F1245/05 polypeptide
MAGNFTAGVNTGMQGAQLGANFGPQGAVIGGIAGFALGFQTPDYEKIAREKYNSEVLKNFAKSLFDTRKVQNIENMRTAQALAAYQDNLRVQGSSYNAQYGAADMIGSSTTALKQAMDFQTQEAKRGVLINWETQVDNMNTSIDAMANQSMAGLRRTKGDTRQMDYAGLVKTGLDLYGQYRNTFNNPNTSTTQLGINKIPDNMSDFGSYGKSGSMGGFGGSGSLFG

SEQ ID NO: 793 - protein, 255 aa, Unknown
  Description of Unknown: Undetermined Phage F1245/05 polypeptide
MPTMVQSPDLITPTISREQAIDRPVEQDGLSTFLQDVLPKVKEGYDQYQKENQDHYIALGMNDELNQITRDVSWLDSRNYEQGKEFQKVSSTQEAQKKAFTDTVTRMAREGKNADEIFDAGREYLTAYTNSVYNSQLSPDLKNALYEAGIKENTIYQKLITKTMSAVAEEREQFDAQTRVAGLYQTVSTGLDDQEINDALEAHVRKAYAAKIAVGVDPKEAMNAAQNEISATFKFWNGQIDPSSPNASEQVNNLR

SEQ ID NO: 794 - protein, 255 aa, Unknown
  Description of Unknown: Undetermined Phage F1245/05 polypeptide
MASKYGVGKDIRTLEAVQPDIPENIGTGKGKKLIGTLAADSYKPLGRANTADLLVPEQQLQDAKAREEASLLETVTAAVAPTARDWGNAIYESYKFTPDVFYRPDADAQEFFNEYQITNQDEVAYINAANSYEDMEFRKRRILDRRDDQQKIADNPITGIVASMFDIDAAAMLVPAVGEVAGAAKFGRIAQRTANASIGAGGAYAINSALEDKSTRTQTERDLDSLTFGLVGFMSPIKYKPKELDAAITKEMADV

SEQ ID NO: 795 - protein, 255 aa, Unknown
  Description of Unknown: Undetermined Phage F1245/05 polypeptide
MAINQKQSYSEYDVSTPQGDFAIGFEDYNEGEKDRINVTVDGDDAASKGYTVLRKNALTIAMTPFVPSGIVRLTRETNIDTTFYKFTAGAIFDAANVDANFTQVLHSQQEVRDRQSYVEGRVLPLVTGLEDALAKADEASKAAQEAAEAAAEAAQQTRSADKVIDASGLTQQDINNRLAITYPTAVGLVGKPNLKDADVVYVQSYSNIFDGGDGYYRVSADTTTVADGAYVIRINPNLIATMLNTTGSVDVARFG

SEQ ID NO: 796 - protein, 121 aa, Unknown
  Description of Unknown: Undetermined Phage F1245/05 polypeptide
MNIVDQIYFGLVYVWSSLDKLIMGAAATAFVVALLRTRKRDGKASWIEATLCGIFATIALVGFSFIAPILVGILAGMGITINLPVDPSAGIAGIVAGFIGWYGTERTIEFVEDNLGGDKNG

SEQ ID NO: 797 - protein, 195 aa, Unknown
  Description of Unknown: Undetermined Phage F1245/05 polypeptide
MGKFITLDEITSKAKEYGIETAALRAVMDVECKGHGFNSDGAPVILFERHKFYYGLQAINWITKSKEWYKLYPDICNPSWGGYGKESQQHERLRRASALNRDVALESASWGLGQVLGENWKDLGYKSLQDFINAMYKDEVSQLDAMCRFIKHNGLIKHIQSKSWAKFARAYNGPKYADNKYDTKLAAAYKKFGGI

SEQ ID NO: 798 - protein, 118 aa, Unknown
  Description of Unknown: Undetermined Phage F1245/05 polypeptide
MAKRNSASVSLMNELHAAIASYMLARLKASIPDPNAPVEYDEETGEEIPAFFIPLAASELQVMVTFLNNNKITATPDVEHMAALANEFKGDLEAARKERAESITKVNENDAFMASLLS

SEQ ID NO: 799 - protein, 255 aa, Unknown
  Description of Unknown: Undetermined Phage F1245/05 polypeptide
MGRVSRITEQTKRRLAMLLERCNRYKDNPVAIPAEEREELSMMFAATFKGFAEFAELGMKYLGFDLSEIQDDIAEYMQYGPAKKMVQAQRGQAKSTLAALYCIWRLIQNPTARILIVSGGERQASDVALLIIRIIMQWGILCWMRPDTSKGDRTSASAFDIHYSLKGIDKSASVSCVGITANLQGMRADFILADDIETQRNSMTQTEREKLLLLTKEFAAICITGEIMYLGTPQTKDSVYRSLPARGYDVRVWCG

SEQ ID NO: 800 - protein, 32 aa, Unknown
  Description of Unknown: Undetermined Phage F1245/05 polypeptide
MSPEEIRRRLDTITERIANAVMIVNLIKEKSK

SEQ ID NO: 801 - protein, 52 aa, Unknown
  Description of Unknown: Undetermined Phage F1245/05 polypeptide
MSTKREVVVQAVDNAVSVAKAVNANAEYKHKDKVTKGLELAGNVLQLLKLFK

SEQ ID NO: 802 - protein, 51 aa, Unknown
  Description of Unknown: Undetermined Phage F1245/05 polypeptide
MDGFESTVKVGVKHTQYEELRDLKQRGETFDDVIRRLLDAHKSLKSIGLLD

SEQ ID NO: 803 - protein, 43 aa, Unknown
  Description of Unknown: Undetermined Phage F1245/05 polypeptide
LYSSLSSIYSITLIVISIYIYIVISYCSLFMFFILYSYTCSIQ

SEQ ID NO: 804 - protein, 72 aa, Unknown
  Description of Unknown: Undetermined Phage F1245/05 polypeptide
MKTLTHHIAVQCTCGATGQTGDFLVDIEHFKLTGELIALDGMVFRSLTALYAYANTYGLPTKRLNTPIVYQS

SEQ ID NO: 805 - protein, 172 aa, Unknown
  Description of Unknown: Undetermined Phage F1245/05 polypeptide
MKLLLNVQEINKAIESIANRGKKLDHDIHVAGVSVLKHVAEHGDTTLLDKLVNAMPKGARKGAFCEWALAFGNVRMLDRSNEADKLAIEQGRLFAKDKTKEYNEVEAMAKAWYDFKPEPDLLTTFDAAQAVKSLLKKYKTALDNGAEIKGGDVAMQQLKSFMQTLNTMDEQV

SEQ ID NO: 806 - protein, 67 aa, Unknown
  Description of Unknown: Undetermined Phage F1245/05 polypeptide
MKVKVRNKFAAATSINYKGHYVVRNGNGTLTLGAEHITEEQAAVLNLQEFSKVREWLGPSYSVEIIV

SEQ ID NO: 807 - protein, 164 aa, Unknown
  Description of Unknown: Undetermined Phage F1245/05 polypeptide
MVTDMTDTKDQGYDLGDENLLSVAKLAMRRGEYLLSAWDQFAAMDIVDGLNRIPSADGLIVYLKHGLCTNIRFEISPMANHRLRGSQALDSLLELAYPQWDGYSGNSTYPVDGYYEYEGYTEDGEHDAGMYHEPNLFRNPKRKELLTWLVTSFLPEYIKHWSAE

SEQ ID NO: 808 - protein, 169 aa, Unknown
  Description of Unknown: Undetermined Phage F1245/05 polypeptide
MLIVPKVNPNVTVTLNIGLGESIAWGKYKKENAEHGPVQSLVDILDTPHRVARILERIQGMAYNPNQHHHGPHVAHNSYGIDYGHHVLPNVNWRTVQVGNEMTLVVKFEAVARDIIGQVFYLAEELKQDCIAVWIHNDTNGGIGQLIGRYNYVWSGGYFNPEYFVHLEV

SEQ ID NO: 809 - protein, 34 aa, Unknown
  Description of Unknown: Undetermined Phage F1245/05 polypeptide
MFKEYNYCGQCRVNYINCHCPTHYPERNKDDHHL

SEQ ID NO: 810 - protein, 27 aa, Unknown
  Description of Unknown: Undetermined Phage F1245/05 peptide
MKKLGLIVVYTAAYAAISLVQWLQDDK

SEQ ID NO: 811 - protein, 189 aa, Unknown
  Description of Unknown: Undetermined Phage F1245/05 polypeptide
MFVLKSTHQKALDEIKSLRAQLDAAAKTKRELQERIDSVRKVRDTVIKYNACLTALCQYLPEGVYRIDYGAERRSCSTLRKTSVVSYSTSVTVDHKAAKMTNRNYTIQHEPLARTCKQAELTARLVALEVQYNIINRDIVVLDQTIKLAQALYDVPTVCHSVTKRSVLSKQRKRIKHELDLVKVELNNL

SEQ ID NO: 812 - protein, 255 aa, Unknown
  Description of Unknown: Undetermined Phage F1245/05 polypeptide
MKYYDNSHPELQGYKQFIPENPNQWFDLMSANRAVFIREDKRVDADVWDMIVQHLTGVSYKPHRYGEGKRHYTEFQLLQGHRKLGEGYCSRVYTHPTNPERVVKFFERYHEDVCCYEYLRMCVQGKLPVFDWLPEVHSLACIKVLIREDDKVRIITYGVAVFPRYDPIESDYEKQNRFVQDGINAEFKKYVHPYLPHARIDLHWGNIMWDRRLNQYVATDPVINSAPVETHVQTIDWFPKEISAKYSGATACSRP

SEQ ID NO: 813 - protein, 101 aa, Unknown
  Description of Unknown: Undetermined Phage F1245/05 polypeptide
MVVYGNVIFERDLAQTMYKRMSSRLADGVRRCCMVDEHTLYFESEVSDRLSRKKFNNILTGQRIAPYSEIKYPKVGEHTLMSDQAIAEAKAILSSETRTRS

SEQ ID NO: 814 - protein, 67 aa, Unknown
  Description of Unknown: Undetermined Phage F1245/05 polypeptide
VKHVHVVEVIMWILIMSIVVGSYRGVSATTQEFTSKERCMVAAQMALDKKMGGGDNSNRLTAICVPK

SEQ ID NO: 815 - protein, 176 aa, Unknown
  Description of Unknown: Undetermined Phage F1245/05 polypeptide
MSLAKQFNAAGIRGSKPKSDKGWTFKAQKAYVRNRFENVERVIAPVYNHKVEQVARAIIVETPLASLNVVAQGSSLHYDYSPDTLVRIGKLTRKGATFSADSNSALAILGLNGAAVLYWLGGLRINIDEQQYEVITNDGEYIYATVGIILQLARDCVFNRDAVLANFQGAKRVRAK

SEQ ID NO: 816 - protein, 40 aa, Unknown
  Description of Unknown: Undetermined Phage F1245/05 polypeptide
VSAPNNIFHKGMRVIVTKADRDDVRLGLHGDTIATVVGVH

What is claimed is:

1. A method of treating or reducing the incidence of a *Pseudomonas aeruginosa* bacterial infection in a subject in need thereof, said method comprising administering to said subject an effective amount of a pharmaceutical composition comprising a purified bacteriophage having a nucleic acid sequence of SEQ ID NO:3 and a pharmaceutically acceptable carrier.

2. The method of claim 1, wherein the infection is a nosocomial infection.

3. The method of claim 1 further comprising administering to said subject an antibiotic for treating infection by *Pseudomonas aeruginosa*.

4. The method of claim 1, wherein said pharmaceutical composition further comprises one or more additional bacteriophage known to have antibacterial or antimicrobial activity against *Pseudomonas aeruginosa*, and/or one or more additional bacteriophage known to have antibacterial or antimicrobial activity against bacteria other than *Pseudomonas aeruginosa*.

5. The method of claim 1, wherein the pharmaceutical composition is administered topically.

6. The method of claim 1, wherein the infection is an infection of the skin.

7. The method of claim 6, wherein the pharmaceutical composition is administered topically.

8. The method of claim 1, wherein the infection is an infection associated with a burn injury or diabetic foot ulcer.

9. The method of claim 8, wherein the pharmaceutical composition is administered topically.

10. The method of claim 1, wherein the infection is an infection of the lungs.

11. The method of claim 10, wherein the pharmaceutical composition is administered by inhalation.

12. The method of claim 11, wherein administration by inhalation uses a pump, a spray or a nebulizer.

13. The method of claim 11, wherein the pharmaceutical composition for administration by inhalation comprises a dry powder inhaler or an aerosol spray.

14. The method of claim 1, wherein the infection is an infection of the urinary tract or kidneys.

15. The method of claim 14, wherein the pharmaceutical composition is administered by a catheter.

16. The method of claim 1, wherein the subject is a mammal.

* * * * *